United States Patent 9,567,581 (SELECTIVE REACTIVATION OF GENES ON THE INACTIVE X CHROMOSOME) - sequence listing, part 46

SEQ ID NO: 4771 - DNA, 118629 bp, human
agtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcaggtaaagccaagttttctttctttgtcttggatgaataaggtgtgtttatctgtgtctctgtgtgaaaatcctggtgcttttgtttcctacttaaatgcatgcagcatacttgcagtgcttctttttgtagggtgaaaagtttgtgacagtccaagttgatcaattcttttgatctgacaatttgctggaagacaatcatttagtgtttgaatggattctgtcacataatgatggtgagcagaaacgcaattatcattttaaaatttgcatagctgtctccatgaagttatggtaggaaaaacagagagagagagagggagggggagagagagagagatcatatttttaggaaaaccaccaactaccacaacttggtgtctggggcacagtgtttttgggacaggtactgaatgaaaggagagggagtgttggcagctaccctgtcttgttgcagtgatgaactctggagagagactgggagtgggagtgtaagatgggaaagggagatgagggggaggagagaacaggagtgtgtggagatgcaggtgattagtggtttttagtttattcttggcttgttttttatctagtccccaaacatctggctatataaagtgaaattctatcaggcatctgtatgttttcaaatatctggttggttggtagtgtggagaccaaacatcccaatgaggaacaagactttgcatccagatgtttcagtaaaaatagcaatcttctagagttgatgatgctttcctctaatgtgagactgtgttgtggcattaagatctggttcctaccagtggatgtcactgtgggctattgtgttacagtttctcttgaagtgtgtgaaggatgtgtgtgtgtctgtgtgtgtatgggggggggagggagagagagagggatagaagggggaggaaaagggagaaaagaagaaacacagtattttttaaaaagatttcctgataagcacattagaaggtcttactgaagccctttcttacatttggatagagcacataagtctaagcatttctagaatcctagaatccaatttaggataatacatgacattttttttccagcagtgtctcatcgaaacagttgaaaaaagttgtttctttagtttgctgaaaatgaatgatgctgctatttacaaccaaggtgtgtgtgtgctttcaacacacctacacatcagtgtgtcttttgtgccatttgtgtctgcatgttaatcagtcaaaatatgttcctgtaggttcagtttgtatttgacaccgtctgaaatgcacacttctgtgaatcagagccccctgaatatgtaacagccatgcaattattgtttcccttttactattctctgcgttacacaagttagtagacaaatgctaaccacacatgaatatcaatcaggtgccataaaagagcagctgcaatgcctcataaatgctttaatcctgttactagtgaaatggccatgacttttctttccttcagcaccaagtcatttcagatgggagaaatgtaaattaatattgctcttagctttcaaacctgtgactgctagtggcgatttttataggagaaaaatgtggggtcaataaaattttatttatatggagataattatggagaggactctttttaagccatcttctcagcataaagtaaatgcataagatcctttccttgatgaaaaagaaatcagcttgaaataaagatattgaaggctttgccacctcttggtgatgtatgactagaagtgagagccctttctgagaacttgccaaggagatgattaaacaggaggagagcatctgaatattgaaaaaaaaaaaaaagagtaaatctcagtgctctccaacttcacccaaatgtgtattttgtgaagcgttctgtttcctgtgatggtttgggattaatgaagtacagtataattaaataattggttaatacagaaagggctgcacaatgaatgcttcagctgaataatttgatggggcattgccaaagttactcatcttgggtaaacaaaatgattaaaatttcccattgattctgtaaacagattagaatagaaaatcaaccttagtactagggttttggggattttatctgctcccaaaccccagtagtaccagtttgccatcactgcaaatcttcctgagcacagagcgaaggggtgaggggaactcaattgcttaactctaggtagatcctggggacagagcaagaatttgcctctgtagatgtgtagtctccctatctgctcagactttttagaaacctaaagttcaggagcgtgtctttccatgtgattaggcagaggtttctttttctaagcctccgcagaacctcttcctgaaatgcattcatttatgagacttgcgagatgatctgcaattgctgcttgaattgggctccctttttgtattcagacaattagctttgtcgagtgagaataaggcacagtctttcccttgtaaagatcaacctgtattacttattaaccctattgttttgctgattattgcccagaaatcgaatttccaaaaaagaaactgaatcattatgtgcaaagtaataaatgactttgagaatctggctacatttaaatgtatttcttttgacaagtctcttaatgcctggtgtctttggtgcacgttgctgggtctgtgtcagtgttaattaaattgagctctttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagaggtaaaaaggcatttcccctcatttaaatgggtttggctattagatttttctaggagaggagggggtcggggggtgagtaaaagggaaccgggctagggcagggaggagggtgtggaggagacgcgaaagaatggggtctgatctcctaccccagtccaaaactgatcgagtgagtcatagaggaagctgattgagggcgtgtgccacatggcaaatgcctggaggaactggcaagggggtgggggcgggtattttttattttcctctatctcctctttggtgacttgctttgtatttcacctaggagttccttttggttccagggaagctccagatttgagcattttcatgctttctctcccataggctcaactttccctgtccccccacccgtgctcacaggccactcacaatgaaaaattccaaatccaaagtatagaaacttttttagggggggttggtgggaggttactatgtttaatatgaaaagtttatggccctcagcctgttttcccttgtaaaaagcacagggagaaacccgatgatgtaatgcaccagaataaggagctggagcggagatggggtgcaaccctctggggtgcttaatgtttattaatcagtgcatgatttgggagggtgttagtgattcatgctgccttttctgtcacatagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgaggtgagtgcagctaagtggctctgtgaggttctcccaggtctccttctttagctgctcgctggataccataagctgctgtgctggcacatcccctggcaggggtggggagaatttctctgcttatgcccattttcatactaagggtttgctatcagtgcttcttggagcaaaaggtaacccaacatactgggcctttgtgtaggtatgggtattggaattggtaactcaaagagtctgagcccttgaaatcattatcctggcataactcaagtttgctccacctgttgcaaatatagcatgcttgacagccagcagtaccagtatgccagtaaagtggcttagaaagagtcatcaagtagtgttgaaaatggatgaaaccctctaatgccctgggaccaattttccagtgtgagagtgattcagcctcctaaagaccccatttgctttttctttcgtcacatcactgttctctagcattttggtgagagaatatggataggctggttaaagggaggcaaagcaaaaaaattaaaaagccactttgccatttcttagcagttctagtggtaacatttgatggttgaggagattgaaactgtcattattgctgaaaatttaagaattagttggctggttgcagtggctcacacctgtaatcccagtactttgagaggccgaggcaggagaatcggttgagcctggaattccagaccagcttgccagcctgggcaatatagtgagacttcgtctctaacaacgaaaaaaaaaaagagtaagaataagaataagaattatctatgcatttgagtgagctctgtttctttctcttcactgggaatgaatgtatttaagtagaattttttttttttttttgagatggagtttctcttgttgtccaggctagagtgcaatggcacaatgttggctcaccgcaacctccacctcccggcttcaagcaattctcctgctccagcctccagagtagctgggattacaggcatgcaccaccacgcccagctaattttgtatttttagtagagacggggtttcaccatgttggtcaggctggtctcaaactcctgactgcaggtgatcctcccacctcagcctcccaaagtgctgggattacaggcatgagccactgcaccgggcttaagtagaaatattttttaaaatgtgatgtggtcagatgtttgctggctattgaaatattttagggcagtagagtggtatatggatgatggctggtgggtggctgggaggaaggctataagtaacatttcttaagttgatttcatttttccatgaattgcttaagtccctctttggttagaaatctgatgcactgggaggcatatgtcctcttccaagctaccagcgaaaagaatactgcatacttagagagcactttcacatctttcaaagcaccttcccaaacattgtttcgtttgatcctcacaatcaggtatcttgataggttgcccttcagtagatgatgaaacagaggtccagagatgctaagggacttactcagactcacaaagctggtcatcaagagagggaggacgagactgaaggactctatactgcctggcaaatgtgatttcagtgacaccttcctgccttaaaagtaattcagcctgacatacccaggctatgatgcatacataaaatggcctcatagtatttgtgtcaattttgtaggataaggggtcttaggaccacttacattgattgcttcttctagttcctgaacaataattcccatcagaattaatggggccaaacagcagtgcttttgatgagtaactgatggtattctgccagcaacaaaagcaccaatattttcaatttataactctataaataaggattttttgaaagtccagtattgtgctaggtaaactcagttataattattaatgtcagtgaatactactaaggcctaggccgtagactacttacaagactacttgtggatcaccaatagctcagcaatagaaagtgagaggtagtggtgtgtagtggaatcagattgatcatgattttgaatccaggaatcactgcttgctgtggaacataagactctgtttctttatctacaaaatgggcacacctgtcatgcaaagttgttccaaggaatatgacttgtgtagtgtagtaggttcaactcattggtgtccccaaaatagtagacctcttcactatacagttggagaatcagtgttacaatggcttgcactactgattgtgtctccctaggcacttgtaaccaaagaggaatttaggctgcttctatatagatacatcctacaaagtattatggccatactactcatattgatcatttaaacaatagaggtgaaagatgccaaagttgtggggttcagttgttcacaagtaacggcactgttacttgtggagatggacaaaagggttgaatcctgaggacttggtgatcacttaggcaatcaattcaaggcactagagaaatgtgagttctggtgtctatgaaatagatggagaggacagaaaacatatgacgacatctgattggtttacctaagacttagtatcatttctgggattcttccatgggctgaatgaaacaaaatattgcttcaattatttagaaaagccgtttaaaatctcagttctgatcctgtctctgactcacaaagccagatgcttttccttggttaacaaaattacacagttttggtgtgtacagctggtcatggccaagacagtgtgtactagacatagtgaggttgtgtgtatttctaatattcagtccctcctggagagttcaactggcaaacccattcagaaaggagagaggcccacttacagctgaatacagaccaggccatttaacctgaatcagtcacaatgccctgcgtagggaaaatgacacttcttttcttttataccaaaggccactggactcggtggaatacttaggtccaatgaaatctatagaagagcagggatgattgatttgttcattcaactgatatttgttgagcctactctttgtaaggcactgctctaggctctggcgttagagagatgaaaaagacaagaaatgcacattctaaagtgtgagacaatcaagtaaataggtgatttgcaatatagagtaataaatgctaatatagggtgcaatgggacattctccattgctaggataataacattttgatatatttcctacattatctttatattttcctaattaattaattaatccattcaagaaagcaacatttattaagcaattatagcatagaatgataagtgctatgatgtggcaaatataagattctatagaaatttctctatattatgttacttacattgttctttatattatttcattaaaccattctttcatttgttcattaatttatcccattagcagttattatacatttagaatgtgccagataatgtactacttcccggggatcaaaaataataaaacacttgtttcttgaacccagggagcttacagaaatacagacaagtaaacaggtaatttcaattcagaataacatcctattcctgagcacgttacattcttactctccaggttgggacaaaagggtactacatagtaggttcctctgttgggttacctgtgtcaaacccagtccctttatgagctgtagatccagttacagggcttactctcaaagggattatagacgagtccactcagacctgttgcgtgctagctgtactcactctatcacactttgaaatttatcaccatggcattagatcaagtcagcaagcattgttggagtatccactatgtgctcagctgtgtggcagggaccatggagattccaaataagtttaagacgtaacttctgccctcagagagttcacagtctagttggggagctaagatcacccacaatgatttcacgggcaagcaatacaagatagtttctgatcacctgtcgctttgtagactcctaagaactcctttctcctcctttaatggcagccttacattttatgtagatttgccattgaaccctcaaaatttagtgctgaatggaagatagctcttgtatcagtgtccaaacctagccacatctgaacattgttggctctagaagctaacagaaatatgactttgaatgcagttaggtaggcaaggtaaagggaatggaacactaatcaagaattggaactcagtttacagtattgcagagataatcttgtgtagaattgtatatcattatttacttgtcctctgatgttggctgggaaatcagctatgtggattttgtggtttcgtacacaaatttgaggggcaaagtggaggatgcctttgctgtttacagaagacttttgtagaattattgatgtcaggtatcttttacatattttaaactgaaaggtgaggtttgcattccttggtatcctggtttattttactcatagacttagtgtatatgtgaatgaattagagggcgtgtgtatgtgtgtgtgtatgtgtgtgtgtgtgtgtatgagggcgtagaaaagagtgaagagagaggaaaggaggttgaaaaagaaggaaaatggagaagaaagatagtaggtttgtcagtttgctaagatctttctaaaaatagtccaaattttttgagaggctccttagtaaggcaaatgatttttcttccggtcttatggaatggagacatgcctactggtgtctctggatgctggaaagtgttattcctttgtacagcagcattgctgcattaccatttttgtcacctggctgcagtcattattggaggaagaaaatgcaactcattgcttctactggaaatggagacttgggtgaggcttcttcttgcctccaggaggggtgaaatggcccaaacacccagtgtctttgtgcagtatttttaaattttagttttctgatgttgaatgtttctgagctgacagctgtaagggagtgatagtaggcaaaaacttagagaattccagtcataggtccgtagggatttaaattttggtttcagtctcaatcttgaattctattttctacctttcatcagcaaactgtagtttctttgatatgaggcatctaaggggtgtgtgtgcatgctctgctatagccactcatgcaacagtcttcataagtagtgacgtagccgtggaagagcttgcagaacaagaatgtgtgtggcagccaaattgaatgcttccaattatcctacaaaaagtctgaatgcatggtcatcttagtggaaataatgaaaataaaacatcagttaggctttgaaaaaaaatagcccagtacactttagttcctaaaacagagttttaaagttagagatttgcagtgacttgaatgaaattctgggctaaattagacagccacaaacctatcaggtagtagattcagaaggcactaaaaaataataggtatgataaggctggtttggatagcatggaaatgacacaaagcatcacctctaattaaaagaaaccaacaaaccctttagtgcgcgtcttgtttgtttgtctccttattacagtagggtcttggaatcatttaagtcctatccctaagggtcaaaagtaaccctgaaggagaaagcaatgagaaacaatgcagcccacatcttttcgagcattctcatttcagttttcttcaaaaatcaagggctcaatttctaccagcagtcattctagggccacccattgcctacattgtatcttattggcatgtttcacctctagctgagacagccggtttcccagtggggatgggcttgcaagatgtgttccagaataaactgttcctctgttgtctccatgcaactgccacagaactgcagaactgagttagtttacattagtatctgctaatttattattatcattccttatcggcaattaactggttaccttagagatcacctctctccccgtacaccttcactgaagttgagctcagccagagctcttgctaatcatcctgagatttttctccccaaggggctggaggcaggacattttccacagagggctctaaggctttggaattcctcttatcagaggaccacttgttttgggtccaggtggctccacctggttttttctctgattgtcagtcagacttacaaggtaggatgagctgcagacctctctctccctaaccttgccccagcttgtgctgtggcttgggcttattgtgcccagcgcagaagctaagggcttaggggattgcttgttaggaattaggggactgaaaaaggatgaagtcacctcctggcaaagctggagtctttcaattgtggcagtgctgtggctcttaggcgtctgcctcgagtttcagatgttggcccctctgcatgtgtacctcagcttccaggatttaggggaggccaagcttggttgaatcgagtgtctcagatttgggtaaataaagccgtttttacaagaggcctgtgtgtgagaggtgggaggatggctctggagcagccattttcccccacggagaagaggcttgatttcttgatgcgtgactggctggcctttgatgtgagcctcatttacttcgaacaattgagaggcttgaagtgaaaatcccagaggatcagttgtttgcagagggaaatgctcttcaagttacatttcctatttggctgttgtgtatttagagtagtttttgtgtgggctgcatagtggggtcactcagcttctagtgggtgtacccaggctgctagcacctccctgtgccccccaggggaatgatgaggaacattcctgcagctgtggggacagcaactctgccaactccgggagcttgagctcctgtgcagaaaccttacttgttatcattaggcatattggttaggaccacacagctccacagcatttctagaagaggtgtcagaatggaccagtgtttccactctacagtaatgaaaatggaaaaggcaaatgacttacccaggcacacaacatttgcggccaaacaagcctccattttgcttcacagtagttcctctggtgcagcttccaagcgttttctgtcacataatgaaaaacctgacaggactctctaggaggacctgcgggtatactttcgatggtagttgtgttcctgaaaagctggtcagccaaagggtgtttgttttgtaaattagaccccatgctaatcacagcagtggaattctgtatttaaagaaagcctgtgatggatcctttcataaaggagagtccttatataatgtgaataatcaactcctaactgatttcttttgtaagtctggattttcacatatcttgtttgcttaaaattagattcctcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtggtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaattagattcctcaaattgacaagatttacaaaacctttgaaaggtgggccaattcatttttcccttgattgaaatctggcccttgaatcctcactggttagccttcctgtttgatttttacttaattaaacaacttgcaactatgtaatatttaaaatatagtgtccagaaaagatgggtacgtgtcattgaaatttaacaagtattagcatttaatatttgcttcagattctaaaaaaatgaaataaaatatgacagctgccatcttcccatccttttctctcctttgtaaataaacccttggctcaaagaacagaagcccatcacgaatttttttttgtcttcacctgtagagctcgttcctgaagagatggcttcccctttgctgtctcagattatgaaagctccccaagtcagtaaggatttcctggattgggtagagcctgggaattactttggaaagtgaaagagctctcttagacttgcctttaaattcagtgtttggggagggagaaaaatcacttttcagaatggggaaaaaatgagaatgagagtgagacagacaaattgacagacacatgttaggtccagctacctacagaattttgagcagaccctttgggactgaagcaggcaggaagcttggtgtcaagtctgtgttctccttgagctcagtgttcatggactagcaccgcggcttctttttgttgttgttgttgagacggagtctcacttcgtcacctaggctgtagtgcagtggtatgatctcggctcactgcaacctctgcctcccgggttcaagcgattctgctgcctcagcctcctgaatagctgggattacaggcatgcaccactatgcccggctaactttttgtatttttagtagagacagggtttcaccgtgttggccagggtggtctcgaactcctgacctcaggtcatccacccgcctctgcctcccaaagtgctgggattacaggcatgagccactacgcctggctgcatcttggcttcttaatgttagatgcttaagcactgtcttgatgtgcatagtcttctgatgctccattaagtctctgagtgccagggtggccagttttcagtttctcccactgggccccatctggccgctgttctgtggcaagctgctctccctcactgccaccagcactggccttggcggtctctgccttctggattattttcgctcccaaatctgatttccagagcatgaagggcacctcttctcagattgtgtagtttgctcttctgagcaaaatggattccctgtgtaagccgacaggaagaaaagttcaatccaaaggccagatccctctttaggggagtttgtgtgtgtgtgtgtgtgtgtgtgtgtgtgtgtgtgtgtatgtatgtatgtgtatgtgtgggagagggagagggggaaaggagagagagaaagaagcaggagggaataaaatgaacattatctgcttctctcactcactttttttgcctctgtgatgatggagcctttgccggctgggctgaccgtacacatgtctatgatattaggtcctcagagcccccttcccaactctttgacattctgctggttgtctccctgaggaaatgctcataagcttagttacagcagggtgtgatcccccaaatgtgaggccatgacaccccaatttgatatagctcaaggatagatctctcagagactctttttaattgagatctcggtgagtaggaagcagccaaataatcattgctgtgcatacaactcagcttaagaataccttatagtgcatattttcaatttattagaaattattttctgaggcttgctttctctttttgtttcttttgggcacaattctgtatcaagctttcctcttctttaattctcttggcttgagggagtctgctatggactgcctatgtgtacaggtcgtttgctataaaaccatatcttttctaagtgagaagaatggacagggagaccctgtcaaactgcattcagagggattggcttaacctttaagaggcttttttataactaaaaatgtccgtaatctagcattcatatttgaaacttgacatgcttgagggaggcagggctctggagatacagggacgaacagaggcatatggctacaggtaatggtgaacggcttgttggaagactgatttcctcctctgttctgccaggcacagaggccatggtaaggacacagacacactgcactcataagactggcattgactatgagcttgctgttctgatcatttctttaattagtgcatttccattttttcaagtatagacttttgagtgatggagtatgctaatggtaacatttgttcctaaaagcttaggggagagaacacagtggcattcgtactaaataatggttttttcgtagtgaagattttgcctgattttaaaattgcaaaataattttatggtagttatggctttttggaaacgaatctcaaatactacatatgaaacaccaattttctgtgtggcttgtgcacttactaatggcatgtgtgtgcttacacttctaggtcattctattttgcctttactggtaattctttagaaatagaaaaagaagtgtgctttgttgcagtaaaaaatataataattttctgaaatggaaagaaagctaacctgcctttgcaaaaactatgcattatgtagtggcctgatggagcaaaaccttataaaactggtaagctataaataccatggcactgggcgttgttggaatgacatccggggcttggtctttgcacatctgatcaccaggtaccctcaagaggagatcatggaaggtggagaaaaatccgtacctgtaaaggtttgtggctatgcatggtgtcatatttggaaatatgggatcaaataaatgtgtgtgatgtttccaacactttgctgtcctcactctttgagcctagcaaactctatcaggacagttttctctagtgtgtgagtgagcccaagtgactgtatcatcaaagataaccatctagaaatctgcagttctgaggtaggggagatcactaccaaaacagatgaaacaattaaaaacctcataaaagagaagctttagtttattgaagcctgttattactagggaaatcagaatccaagacatagagaattctgaaaattccagacaaatgccaaactacaccaaacctgcaacaatatgtgaagagattgggttgggggatctccaagttatctttcagctctgggtgtaaatgtgtgaatgtttgcagcattggtttgaagggcttcatatagctgcctgcattgaagtttgagtccatgtgatgacaatggttgctctgtaggtggtattgaaggcagaggacttagctatggcaggtgaaacaataggtacagcacattagcttttaatgagggcagcatattctgtgtataatctgagttgtgagtgtgcatgccaaaactcagagcctctctgttcaaatatgtcttcctgtccaacgcgagttctgccataaaggcagcaatgggtattctaaccttgcttcatttggtttgtacttgttctagggatgaataggagatgcacgcgtcttgcctggcaaactagacctttcaggagagcacaaattcacttaaacataaattatgttgattatcactctacctaaaaatttatagagctggaagtcaccgagatctccttttaagttgggtattcttgaaaactgttttgtatatcatgataaattatctaaccttttatacagttgaaggccaacattatggaaataagcagctttttattccattctaaggtcagtctaaccaaattatgcaacttctaatgcagttgcttgaagcttccactttgaaagttttttcattttaataccttgcaacagagataaatattttagctactattcatgcttaacaatatatttcactgattgtcattctctttgtgggatttgttggcgtgagaggcagtccaccatgcctctgctcattttgatgtttgttataggttatcagaaaagagccagaattcaataaaaaatgtatttttgttcttgctgttatttttaatttcaggccataggaggctgactgagccctacagaatcaatatatacttggcacttggggtttgacttaagagccaaaaatgtggtagattttcttttaaactagatttgattccagaattattaaacccaatgcatgttggaggctgatggactgcatccagcaggatttggggcactttctgtaacaaagcaatttatttctttcagggagtcactgctacttcaggggaaggtgcagtcggtggggacgcccttggaagttctgttctatcctaggctccctaaacaataatttgtaggagctccttgatggtaggatcaactctatgcagtttcttttggatagtgtcaggtgtttattaaatgtattttgttactgatgactagctctatagtggttatagtgccctgctgttagagagtattcatttattctgggtcaaaccttgccctctatgatgatttgcctccagactttagtgaatggacttactgtttagtagttaggctctttaaaaaaatattttggcttgaaaatatccactcattcatccatccaccaaatatttatagatcatccttcactgaccaggcctgtattcagcccagagagacatagagaaagcataagtagtacctcaccttgtagtttatattgccactgaggagacaagatagaagttaagcacattttctttaagtcaatgagaaaagcagagatcatttactaaatggtgccatgtaattggttaacaattggaaaaaatatgatttatttcccactatatgacaaaaataaatttcacatttattaaagagttaatatgaaaactcaaataataaaatcattagaagaaaatataaataaatatccaattgattttgaagctgaagaggacttcaagagcataaaaacaatgaaaatgagcacaaagaaaaataccagcagctctgactatataaaatttaggaatgtctatatatctacaagtatcataaactaaattaaaaaataagccataagctgggaaaatattttaaatttatagcgcagagaacctatatttattaatttgtttttcagctttattgggagtgtaattgacaagtaggaattgtgtatatttaagatgtacaacttgatgttttgactcatgtatacattgtgaaatgattgccaccatcaaactaattaacatagcctttacctcatatagttaccattttttaaaatggtgagaacacttaagatctactctcctagaaaatttcaggaatacaatacagtattgttaattatagtcaccatgctagacattaaatctccagaacttatcttgtataactgaaactttgtatcctttggccaatatcttcctatttcccccacccacaacccctggcaaccaccgttctgttctccttctatgaagaacctgtgcttattaattcattaattaatgcttcaattatttatagagtgcttaccacatgttagtcactattcaaggtgctagggatacaacagtgaacaaaaatctctgtctccattgagtttacatttttatggacagatggtgatacgaagaaaaataaggaagtatgaagcatacatgttttgtcgagaatgaggattgctctaggaaggtcagggaagacatctcaaataagaggacttttaaacaatacccttatatataaagagctcttacaaaacaatgaaaagacaaacaccccaatataaaaaatgtaaaatgaacacaaatgggtaattaataaagaagccattcaaatggccaatagatatataaaaatatttcaaccatagtaatcaaataatagcaatgaactgctattaatttttaattgcaaagatgatgcctacttactactaaaaagtcaaggaacacaggaatgtgtaaaacaaaagttaaagtctccacaactatttcctcaccaatctgttacctcaggggaatcacagacaacgatttgatatgtaagatgtcattttgtacttatcaaataagcaaagattaaaaaaaaaacagtgatggcaagagtgtggttatgatacactgcaacatggagtataatttaaaaaattgatataatctttcctgggggcaatttggcaatacacattaaaagccctaagatatctaatatttctacttctggaatttatcctaaggaaataattttagatcagcgtaaaaattcatgtacagggttgttaatctcagtataatttatgaggataaaacatcggaaatatcctaaatatcatcaatatgttaatagctaaatatattatgatatatacatatgctagaatactgtgaagccagtagaatgttttgaggaatacttaattacacatgaaaatatggtataatatacattaattgaaaaaatcagaaaataacacacatagattaattccagtttaatgtatgcatatattattccaattgtttaactataatacaatatataaatatatataatatataaacaattccaattgtgtgtatatatatgtgcgtgtatgtgtgtgtgtacatatatatattcatacacacacatacacatgcacatatgcacacacataagactagaaagaaaattaccaaagcattaacagttatctcaggttgtaggaagtcaggcaatttttactttttaaatggtatacttttttaattttccaaattttctgcattgaacatgtgttatttttgacatcagaaaagcaattacttaaattaaccgtaatactatgcagtaggtattaagggccaaaaaggtggcatagacagtttttaatgagttattccgaggaggggcagaccaaaatgttccttattttcattttccaattagatcataccaattttttcttcttaattttcttctcttggaggtctctctcagaaggtaacaagtatgaagttttacattttaaaataactattttatttacagtttaccttttaaatgtgagaaatgttatgaacaatatttgtttcctttttcattctttttgtccttgtgtatactcttgtaaaagtagatttgatttgtctcaccagtgttagacatctagttcacatactttatttttagaatgagaggttttaaaatagtaaaatttaactgcaacttatacatatatttaatactatagaaatgatataggctttatctaagggccacttttggcaaaatatatttttttcagtgcccttttcagtaccaaatggccaatttggagggaagtgcttttttagtattctccaatacttgatttcatgttcttgcttctcggctctgaagcatcctgtttcaacatgatagccccaaccatgtggaacacaaaaaagaaggagtcaatgatttggtggtcattgagatgctaaaaattttaaattcaaccttgactaaatgcactatttgtgttcttttttcaacaaattagaatgggttcaatccttttctgaaaggcagatttatttgattgcttcctcatctagtaacctagttttggacagcataaatacaaaagccaacatcctttggaacacctctttaattgatggctgtataaacttctcacatcctaagcagcacagttaagggcaaaatatttaattcagtggtcctgtgtagatagacatcagaactacttagatattgtaaagaaaattctcatggaaaaaaaactcacacagatgcttcactctccaccccatagccaatgcatgagaaccctgtacaacatcactctgattgtgaatgaaatctttgctacaggaaagtgtctgtggcctaattctgtagtctgtcccttggataaatggagactatgactttcagcaggactatatatttcttatatgtgcaaccatttaactagatgggtttaaatttgaattataaggttttcatgttacagcatggagcatttgatagaaagaaatatcttgattttttcatgtgagtgggcatgaaagaagggtctaaaaattgagggacctcccaccccagcctcctttgtagttcagttccttaaagtaaaagtcttcatttaaagaagtattgagaatgtttgaaacttgattatggagcaacttaagattcatattttctcttcagatggcttaaagttgagattgtttggattagaaaagaatttccatgaaattaaaatatttaattgcagttaagccaggatttggaaaaagttaatgtgataaagcagagtgttctagctgaaaaaaatttatgtaatattatgtaaattcatatcagcatgaaagttaatataaaaccccagaaggtgataagaagatcgaaagcaaggaattttgtttattgaattcaaattctatttacacttgccaatcagtgagggttttggactggctgtgaagagagccctactaagcacacgatgctttattcgatgtgtgtgaaggcctgactctgaacttgcttatgggccccagacagaccaaaaggccttgaggtacccttagctcccaccctccacttcctatggctgctgttcgctaggtcccaagaacagaactgatgggatgatgtgactgaaatgtttttatttaccagtgccgatgagggagatagaaccatgtagggagatatagatacacaaaagctccctgcaaccaatactaatctcaatgagttggtatttttgaaaacacatatattaatgtcatgactaaataaatgcccaataaatgtttgttgaattaatgagaaaaacatccatggttttaatgttttaaaattttagttgagatcattctatttctcttttctcatctttacattatgttataagattttttctttttttttgagatggagtctcactctgtcacccaggctggagtacagtggctcgatctcggctcactgcaaactctgcctcccaggttcaaaagttcctcctgcctcagcctcccaagtatctgggagtacaggtgcctgctaccatacctggctaatttttgtatttttagtgagacggggtttcgccatgttggccaggttggtctcgaacacctgacctcaagtgatccgcctgcctcggcctcccaaagtgctgggattacaggcatgagccaccatgcccagctaacatttttttctatgtcattagagaatatttataagcaattttttagtggctgaattgtattctgttctacagatagggtttagttttactcaaacaatcgctagcattgaactttgaggttatttaaatttttgttttatataaataacaccatgatggctatccttatatataaattttgttgtgatctctgattgtttgcctgtaataagttctctacaagtgaaattgttttatctgagggtttatatatttttaaaagtggtatttcccccagataagttgtagcaatgtgtactcccactgacagtgtatgaaagcccatttcactgtactggcaaaacattattatagttttaaacgtcaccaccaccaatctggtgaagctgtgggaaaacaggcagtcccatgcattattggtgggagtataattttttttttttttttttttggagacagagtctcactctgtcgcccaggtctgagtgcagtggtgtcatctccattcactgcaacctccaccttccaggttcaagcgattctcctgcctcagcctcccaagtagctgggattacaggtgctcaccacaacgcctggctaatttttgtatttttagtagagacaggttttcaccctgttggccaggctggtcatgaactcctgacctcaggtaacctgcctatctccaccttccgaagagctgggattacaggcgtgagccaccgggcccggcctgggagtataaattagtaccagtcccatagagggcaatttgacaatatctctcaaaattacaaatgcatgtacactttgacccagcaattccacttttagggatttaatcttatagatatgcttgaccacatgaaaaatgatgtatatacaaggttcttcattgatgtattacatgaaatagcaacaatggaaacaatgtgtatgtctgtcagtggaaagttttttttaaaggagtgttttatatattgatatggaaaatctctaaatatattgttaactaaataaaaggaagattcaaaaaaaagcgtagggcacactattatttctgtgaaaaagggagggaaaaagagaatatatatcttattggtttatatatacatgaaattgtatggaagaataaataggaaattaattagaatggagacctgttgggagaatggccaataagaggataggggacaggggtgggaaggagaattattagtttcatagatggaaaatgagtatctaattttagtggaaatttgtatttctttgattactaatatatatattaaggtaaatccctggtttaatttattggaaatacttttcttcagtttgttgaatgacttttaatttgttatgcttatttttgacatagtgttttggaatcatatgaaaaaacaatttgtcagtgctttaatctgcgatttcttctgttgcttttaagctattcaactttctaccaacaaagagactatatatataatatttcttccagtatttttatgaattcacttttacattacattttaaattcattaggaatttattttgacatatagttggaagtatgatgtaaaaaacattttcctagatggttaattggttgagtttgtaccatttattgtttatttcttcttcttcaccgtaactttctggtgcttctgaaaaacatgttgagtttttatagagactaggccctttcctgggctattcatttattttccactgatctgtttgtctactataccaataccacactgatttgattattgatactttataatagattttaatagatagtaggtttagtttctccttattctttgtctttaaaaagagtttcaatttttctgtttattgtttcagatgaactttggagtcatgttaagtctcaaaaatgattatgttgggattttgattgaaaatgtaccaaactgataaatttaggaacaattgacatgtatataatatttagtctttttatctagaaatatgacatctttccatttagtcatgtttcattctaatgtcatcagtatatttacatagttctccttacattttttgttaagattacttctggctatttaatggtttcactgttattttgagtgggctctttattccattacattttctaatcaggcaaagctggcagagtacatacgagagctcttgacttttgcatctctatttcgtatggagcgctccatgttttcttagatacggtttgtcacttgagtgttcatgtaatagttattttgatttattgcatctttgcttttagaagttagagtcaggagccaagtggctttagggaaattacttcctctctgtgcctcagctttcttatctgtaaaataagagtaatgggacctacctcgtagattcttgtgaggattcaatgtgagtgttcaagcacctggcacataataagccatcagtaaatgttaagtagctattactattatgatctctttttgactaggaaaatatctaatttgtgcctcttaatctggaaggaggcaatcagattcttactgcctctagcaatgtactgtagagggcaacacaattgaattttgaaattaaagaaaactttcatttgcctctattctgttactgcaaacaaattccacctcagtgtgcttttctgcttttagttacacaaattcctttttacatcacagtattcttttccttagtggctccttcagagtttctcattgttccttactgtgacacccatctctagttcaaatgtgaagtgggaggaggtcctacgtgaatcagagttagctagatgtgctggccagagagccagaagccctcttctgatgttatcccttagtattttctttccagagtcagtggatatcaatttaggccttaatctggcatttttcaacctttctcctgcatgactctgtgctgggtatctccattagctaggaagctctggagatggcaatttcatggaccactggcttggggttgtgacctgcactttaataaatactaccccaagcctttcttatcctgtgacctgctgcttccgcagacctgggctctgtttcagggccactgccttttcttctttctttcatgcaagtgacttacaaatgaattttaaatagccagttcatggtgaggaacttttgagatcatgttcccaggactatgctctgtctcagacatgttttacttctacccaggaaaccagcttcttgtatctcttatccaagaatattttatactcttttctcaattttggggtgaagtgtagtggcctagggcagggactccaatttcactttggcaacttgtggaacaatttatgcttgtggggggttttaaggaagtgctaggtggcttggggagggggagaacaaaagcttggttatctgttataatatttaacctgaatgtgaaatgtgtgaactctgccaaacagagtctcactgtaagtgaagcattgccaagaaaataataggtaggtggttgtgtctatttctttttttttttttaaattactggatattgttcccaatagtcagcagttgagtactaaccattttctgttcatttcagtacaggctgattattttccttctctagcttatagagttgtaatccatgcacgtataattaaaatgatatccaaatgcagttttcctttgaatttgtagtggctgtgtgtgtagggaaggttgttgctttgctataaaccacagacccagagtaaacctcagctgtgctgcagctattttggacgacagctttctagttgcttgtgtgtaattgcccatattacatcatcccaaccattgtgaaatgtgcaaaatacaaggcttatctaatgattcatttcaggtggacagtttcttttaaattaattttaggagtggttctctgcactaaacagatctccctactttgttcttgcttttttgttcaggcctacggtaatttaatggttgataattgatgtagcagagagaagtgtatcatattcattgtgccagtaacctttacagtctacctaaaatgttccatgggatgtgctttctcttggcgtaagtaaagaaccaaggggagaaaaattccctccacagcatatcaagtaagcattaacctcaaatgaaattaatttccctgtcattgagtagcagagaaaaaagctatcttcaacggctacaagaggcttggtcttactggggtttcagtttgtcatattatactgtctttcattatcacagacatatactatagggaagactttcaatgtctctgttggtggattgcactaactcatctttaagtcaggtatgtgaaattcaagtaagccaagaccttccagtttttttcttatcaatgttgaacattcataggctaggtaatattacatgtttagtcacctactagtaagatgaggtgtttacaactaatatttatctttggccttggaccttctacgttgctcacagagtacagttttgtaaaatgctttataggtaatatttcaaagtggacaaaaaaagaagattgcttagaaccagaaaggtcagaaatagatcaaataatcctgggactttttattgctgaataatggactttgtaaatatcacatgtgactattagaccaaatgagactacatagaattcaatattaattggttcagtatccgctgatggcctgtttgcaggattcaatgaaattatattatcaatacaatgttttattgattccttggtttgcaaaattaaataaacatagcgtaagcacttgcagtggtaagttgtagcagggaaacgggttttgatttggaatttgaaaacaaaattaaaggtgattgaagcagaaagcaggctgtggcataacatttctgccagcacttttgaagtaactgaatatatctgggtgtttgggaggaataagaatcagagaacagagactttggaggaagtgtttcaaaatgctttcttaagggttatttcaatactagcaactcattttgttgaatagtttagtttgctttactatggatatattaatttatttcattctatgctatttttttccagtatctatgccattctttgtgttgttctagataatggctaaatagtggtcagcaaaactgacatagtcccctgccttcatggggtggggggacaaaacaccaacaatataaaattataatgctatgaaagaaaagagcatattattatgaaagagtaaaatggggaaactcaacctagtctgggggaagggaagtaatatttgagctgacccttgaagggtgagcaggagctgtgaggcaaaaaggtgggggacaggaagatggttgacggctggctgttgacattaaactcttggcctaatctcagggaaccatttcccacccctcccccaccaaggtggtctgaatttgagtgccaaagtcttgaatccaacacacagccattcgttaaaaaagtggaaagaggctgaggcaggaggtggtggttgtggtaacacacagagtctaccatgaattctgaaaaaatcaaattcatttcagaaaagcagccatgaaaagaatctgtttcaaagtaaagaaagaagcagcctgcagccagcttcagatggatggtttgtggctcaaatccattcctccagttactgctcgatggcccttttgagtccatgccacctcccacccccaaccaatgtcaatgggtggtgtgcagatgcagctcagtaagatagtgttttagggcatgcaaggctcatctagtcacatttataacatagaatcagagtactgtcaaggcaatatttatcattttatattctttcttggctactcttgataaataggaggtcaagggcctcttcctctttatattccctctggataaacagacagcagtctccagagaagaaaggcgtctttccttccctattttctgcttccaatctgtttctttttccctctttctgctccaactttttttctgtgacgttctgtctgacagtcagcagagggcgtatagacgcatcaaaagccagcctttattcaacttggccaccgtaatttcattgtctttatctcttcatctttacattcctcaaaggcagggatacatcctggcgttttctctttgtaatagtaccatcaagggcaaccattccttacctattttataaaggtgggcaaaagctactgtctagataaagggaaagaagttgtgttcctgagagctgggaggaaatgtgtgtgtgtgtgtgtgtgtgtgtgtgtgtgtgtgtgtgtgtgtatgtgacagatctcagagttgttggtgccctacgtgactcatttgggaaggactcgttttgccaatagcaaagcagacagtctgggttcctcttcttctttgctttcccggggctgttgtcctgatagcagctgccctgcttcctgacatgtcctaataatgaagatgatgtggccagggggagattcatcttcttccctaatctgacttcttcattgaattttccccttactgaagtccaaagaggattgtcccctcttaactgtgtgccctttttactctgcccaaggtcagagaatccagctgtggcctgtctgcctcccacatctctggctgcagagagtgatccatgtttgtctgtgacagctgtgtgaatggtacgtgagaggcagaggagagctgtagtttaagctgctccaaagatgtcttggtatggcagtgctgacgaaaggggagacttgtttgtgtcgatgacataatcagagaagacatccatggcccagctgcagggagtgaagaagtgtgcagcttagtatagtcttctgacaaaagcccacacacttcaggtttatctgcccgtagtgctaatctccttctgatgtcttaacctgacttttgttgtagtttgttcagacggttccagtgacagaaagaattgcttggcttgtggtggttatactggctagcacgttaatacaagtgcagggtgttttataaccaactagtctcataataactacacatgaagaacaggcaaggtttagtttagcatattctgcctattggaaagcatcagacacggttatagctcctcataaataatactgatggctcctaaaggccatttttcatgtaaatttccttactgttagtgagcttgaaaaagaaccgtattgacgaacaggttattttaaaagtagaatgattactcaataaaatacttttcagctttttcctttggggctctggggttcccccttatctcaaggatccacgtgggcagattgcatgttagctggagaacccaatagacacattcttatttccatgccagcaaaacactaataatctaaacacaaaggacatttaacacagtaactgtttctgatggagcaagtggtactgccagctcgctttctcttggatggcttctgtacggtgagagcaggattgggagttgagcccaggctactccttagtttgtgtggtataaatgaacaacttaagaatagtgtttgtatagtcagggtcatttctgccctttctcaatggacttgaaatcctgggctgaatatttatccagcttggttttgtgtttttggaacaaaggaaatttccagtgaccagtctggttaatcaccaacgcttattccctcttcaccactatttcgtattggatttccttctataccagtacattggatttccaatcacatcgaaccctatttggctgccttccattcacagaagattagattcccttacacctcactgcctctcaggatttttctctccacaacgtgtagagtattaggttcccttacatgagttgctgcttgttaagttgtgttcagtgctgcgtagtatcgaattctctttctcatcagcagtcactgggttgttaattacacacttgcagattcacttctcctgcacatgctgtgacacacagctctccaaagctctgaactcacacttcaatgccttagccatatctgcccagattcagtttacttcagctgtgtggtattgaacacctatgcatcagtctgggctagatactgcggagtttacaaaaatgagtgctgaataatccttgccctcaaagagtttacaatctactggggtggatccagggcagggcagtgcataagatgaagaattatgtgcgtgaaggttaagtattggttttactcttttcctagaaacagtttagtatctggcgtatttaaagcaccttagaaggcaacatgttcatcataatgccattattgccaccattctgttccataatgggaagaaaacattaaaaacacaattgtgtgaaaaaaaacccttttaccaggttccaatgcagttattggtagagttggtagaaaactcttaggtctcttaacaaactcttttaacagccctgccttcatacagacttaagacagtattagaaatcatataattctaagagacataaattaggcatagagaaataaacattgctatgtagactgtgctctaacatgccttgacattacttgcaaactaggatctatctctgttgtatttcttttggtaccaaaatactgtgcaattttattcacccctggaaagagagggaaccaaaagtaatacaaagtggagcaagtcatggtttcccacaagcaacagaaagtggagaaggcattaccagttgtgattttattgctcagcattctcaacttcattgcaaattcacaatctagtgtctcacaatggtgtaaatattgcctaataccttcttcatgtagcttctcattccttgaatgcttaacatgtgccaggcactgttccagatgctttactgtagaatcccagttattgctcatcataaatgaatcttctctgcatttgctgtagataaagaaaaaaatctaagttactggcaacaaagggatgtgtttttatccctttctgccaattcaaccagagcacttcattaatgccaaatttctaatttgatgtgaacagcactcctagcatagtctgaagcttgaaatgacagtgatttaaaaagaaaatagtttagaaaaagacctagctaataagaaaagctatttgctataggaattcagtaaaaacccaagctttggtttaagttttttctttaacaataaaatattgtgtcattttaaaaaaaatccctggaaggaagggaaccaaaagtaagtcaaagtggaaagaggtcacaggaccaatgcttttgctgtctacccaatcttttctaactactcatatgtattgtgtgtctaaaattcagagtatgatatctgtcttttcttttttcttttcttttctttttttttttttttttttgagacggagtttcactcttgttgcccaggctggagtgcaatggcgtgatctcggctcactgcaacctccacctcctgggttcaagcgattcacctgcctcagccgcccaagtagctgggattacaggcatgtaccaccatgcccagctaattttgtaatttagtagagacggggtttccccatgttggtcaggctggtctcagactcctgacctcaggtgatccacccaccttagcctcccaaagggctgggattacaggcatgagtcactgcacctggccgatatctgtattttctaacctaattgtgtagcataaagagactttattagtatggaaaagtgacagcaacatttagaactcatttttcaaaggtgtgttactattcaaagcctttggaccatagcaccatttcattagaataatagcatgttgatcctcaattgaaatgccctactttcttgtccatggttatcaccagtagtcagggaggttttcttttccgaggcttgtctttaatcatatagggcttgggactgtactagttcaaccactgtggaagacattgtggcgattcctcaaggatctagaactagaaatatcatttgacctagccatcccattactgggtatatacccaaaggattataaatcatgctgctataaagacacatgtacaggtatgtttattgcggcacgattcacaatagcaaagacttggaaccaacccaaatgtccatcaatgatagactggataaagaaaatgtggcacatatacacaatggaatactatgcagccataaaaaggatgagttaatgtcctttgtagggacatggatgaagctggaaaccatcattctcagcaaactatcgcaaggacacaaaaccaaacaccacatgttctcactcaggtgggaattgaacaatgagaacacttggacacaggaaggggaacatcacacacctgggcctgtcttggggtggagggagggggtatatctaatgtaaatgacgagttaataggtgcagcacaccaacatggcacgtgtatacatatgtaacctgcacgttgtgcacatgtaccctagaacttaaagtataataaaaaaataagaaaaaaatcatatagggcttaatatgaacatctagacacagactttattcttccctaatgctgtccccaaacctttctggagctcctgctatgtgtaatgtagcatgttcctaccttcacaaacattcctgccagggcatgtacttccatagctcaaatatttcatttttttttctttttttttgagatggaatcttgctctgtcgcctgggctggagtgcaaaggcatgatctcggctcactgcaagctccgcctcccaggtgtatgccattctcctgcctcagcctcccgggtagctgggactacaggcgcccaccaccatgcccggctatttttttgtatttttagtagagacggggtttcactgtgttagccaggatggtctcgatctcctgaccttgtgatccgccagcctcggcctcccaaattgctgggattacaggcgtgagccactgcgcttggccaaatatttcatatttcatcttcttttgaatccaagacttgtaagcataatttatggatgatggcttcagagaaacaatgagttacaatgtatcttatgattccttggacatgccttatttaatggtaaagtttccattttccccctgttgctcatttttagctataaagaccataatgccagtcactgcctgaaatctagccaccccctttcacattaatattaatagcataatggcaaacattctgtacattgcctgtgactcacataatcaccatgcaaaatgcatcattcataaattgtttagtgcgacctttggcacagtagcactaattattattatcacagaagcccagtaaactagactggtaattatcagggatttatttgaatggacagctaagctattcttggcaagttagtcaaagcagttgtcatgacagccatacaaatatgtcttatgaattgggttaattagggtaattaataactgttatttgttccccttttcccaagatattgcctcagcattatcaaaagggtgaggggtgtaaactttaaaataatgcttgaatccttctgctaagaaagctactgacgaaatcaatgaaagctacctaccttccaaaggtgctcccttagagaaaccctcatttttatgggaccttctcctacttttggatgtttcagagtcagcaagcacaagccatactgaaaaaaagtagttaaaaagagaagctaaatagtcagttccccgaggctgctgctttccttttagtcacctgtgagaactcccaagagaccatccctctggcttctacttttagcagagccctgctttgttttttgctcatctagaactttcttgccttgctctgcagcctgttcattgtataatttttttttcttatttttccctcacaaggaaattctgagtttttctcacccacatttctgcccctctgaggttttccaagttttaattttgttggaggccttttttaatttaatgccttagggaccatctaacattgcctgatggtggttttgctcttttttcgaagaaaggaaaataggctagctctgaagagctttctctttctcttccttaaaaaagtaaaggataaaagtccaagtttcttctctctgcatcacagcatattaagttgtttttcttattctagtgcaaagaagagagaaagggagaggttaaaaactgaagctgattcttttccccaatgagatgattctttctttcagagtaaatgttgttcacaaaaggactttaagactttttgtgatggttttgaacagcaaatcaatttctctccatttcctgcataaaactaggagaaggaggctgggggaggtggctcacgcctataatcccgagggaggctgaggggggcagatcacaaggtcaagagatcgagaccatcctggccaacatggtgaaaccccgtctctactaaaaatacaaaaattagctgggcgtggtggcacgcgcctgtagtcccagttacttgggaggctgaggcaggagaattgcttgaaccccggaggcggaggttgcagtgagctgaggttgtgccactgcactccagcctggcgacagagcaagactccatcaaaacaaaaacaaaaacagaagagaagggacacaaggcagaaagagaactgaggatgttaattaaacatctaatctatgtcagtttctgggctcagtacttttcatatattaactaatcctcccaacaactctttgagactggaaacattattatcctagctttacaggtaaataaactaaattatatgaaagttaagtatttttctgagatcacacataaacaggacttgaacctcaagtctctgatccagagtctcctttcttctacaccagctagaacagagtttccccaaaaaagcaagaggcttttagtacttcatgaattccagatgccttgctcacgccacaaatttctattgaatataaatgcccatttattttgtttgtttcaatgcctgttcagcaattgagatttctaggtcagtgccagcattctggctgacccataaaattcaagtttgggaggaattctggtaaaatgcttttagcagagggtgttagattaataggttagaaaaagtgccaactttcttcccatgtcatactggaatctcatgatcagaaggtagcttcctctattttactttcagttgccctgttagggaagaaaggctttctattgcagaagtggcttggtggtgcttggaagctgcacaggatatatggaagatggagtggtttagggttctccaggtgtccctgtcctactaagtcagagatcaggatcaggttctgacatcttaggaagctgaaaactgacacacagagacccatttcttttttctttttttctgaggtggagtcttgctctgtcacccaggttggagtgcagtggtgtgatcttggctcactgagcctccacctcctgggttcaagggattctcccatctcagcctctcaagcagctgggattacaggcgtgcgccaccactcctggctaatttttgtgtttttagtagagatgaggtttcaccatactggccgggctggtcttgaactcctgacctcaagtgatccatccgccttggcatcccagtgtgctgggattacaggtgtgagccactgtgcctggcctccatttcttgatatgttattattaaatgggccatggtatcatatatttagtatttttaagttttgtgtgggtgtgtgtgtgtgtgtgtgtgtgtgtgtgtgtgtatagtcatttgtctcgtccatgaaggaccttcattcacttgataaacactttgtgccaggagctgttttcagggttccaggaacagcagtaaactaaacagacaaaaaattcctaacatcatggagttaacattctagcaggggaagagagataataaacaaaataaatatgtgaaatgtatggtattttagaagataagtgatatggagaaaaataaggcagaaaaggaagataatgagttttggagaaaatttgcaaatttaaatagggtggttaggtaaggcttcaatgaggcctaattttatttcttaccacttcacacacaaactttcttctccagcaaagcagatggttcattcattcattaatgcctactctacctacctttatatcctaccaggtatagaatacacatttaaggacaaaacacacttgcccctacccttttggagcccaaagtacaggagatagacgttgaaaaaaataattacacagataattacttgcaattgtgataagtgtgatggaagtagtagaaagtactaacacatactacatatggaggccaatacacagctactaattgtattaagctaaaagccacagatggaccaccaaacatttggtatccctggattctagtaggaaggaccacgatgacatgattacaaagccacaagtctcatttggtttaacctgtgtctagggatctgtgaatttgtgatttcaaatgtttgattgccataattttattagaaaccttcagcctccaacctaggcaattactggcatttgagtttaaacacatgcatacacacacacccacacacacacacacacacacacacacacacatgcacacacactgttgtattctttggaaaacaaatgaccttttgatttggtgtattgtggaactgctagaaaactggcttagaaggagggaaaatgttaatgaaggtaatggctgatttttagagcagagtacctatttgttttttcttgtcctttcattgtgcctccaaagcttcaaaacctcctaaaaatgaaagattataggaaaaaatgcatcttttactttttaaatggtagacagcaaagtattttaatgaggaaatatattatattattctcctacaaaccaagggctaatagtctggaactggtactttggctgcataaaaagtccagcaagacaagccaattatggactctgaaacatttttatttttagttccttgtaatagcgattcattctctgctatggtacattaactgggaaacaagttgaaatgagagttttggcaactttagaataattgactatatttaccaaattcttaatcgtgcagagaggttagcaggggaggggcatagaagaacaaaagattaggtcagggaaaaatacgtctaggagagtctgactttcaataaaggctaaatagacagctttagaatacagttttagagaactcttttttcctttcagtttattcttcaagtagacaacagtttggttatttgtgctgatttctgcctttatgtatgatgtggtgttacttttgtgagcagaagtaattagttgtttacaaatgaagaatgcagtaggcacagctgtgatattcttttccctaccacgagatctggtagtccccaaatttccctctacatctgtgtgcattggtaacactgttaactgctctgttccctttcttttccagtagaatttcttttgtttgggatgactgttacttttccttttggtcctcttttccttcagtggctctgcttgcctatctggtggtcgttttggaagttccaacccagcaccaatccagagtggagctggtgatgccgaaatggaaggagtgtttgggaagggtagatatgttatgagggaatcacgttgaagttaaatgaaccgctaaaacaaatgtaatcttaggcctcattaaggaggtatagttttctgattataagaggtattagtccctctgaattctttgctgttaagactacatctggataatgatgtctgattctggatgccttattttatgtgaaacactgacacactagaatgagcttcaagggaggttaagagactgataaacggcctggagaccacatcacttgtggaacaatgttcatactgcttaattatgagagaggcaaaaagttgtatgaagccaaccttaacattgatctgcagtaggcaaatgtgttgaaatgaagagactaaaactaaactttcacaaaagcatgacacattcttcttagtgtttggcttgttaattagttacgttgagtacaaatatttatagtatttgagtctaggaccagctaactgaccagcacaacagctttcacatactcagcaagggcaattcgttcttaggtataaggccaaagactgacccttgggtgatcatggagatttcccttccctttgtagagtgctctgtatttaatcttctaatcattaaaaaacagatgctcaccactgacagaggtggggttcctagaaaagatggactgatggctgttatgctgtcttccatcttcttgagacccttagcagctttgtagtggtatgctttagtggggttaggaaggagttaatatcttggaaaaaccttggatgtggcttgatttcctcttaggaatattgagaagatgaacacatagtgggaaatttttaaatttactggtgctacaggcttttttccaaaaggcatttgtagtagtaataataatagtaataataatatgcccaaatgacagaagaaatattaacttctgaaaataaaatttcaaaaggcaaattttataatatggttgaccaccttattctttttagatcacctagggagaggtcattcatacctttatttattaattctctatcttctcatgccttattgatttacttttccaaagcacagcagaggaaactttggggggaagagataaaagtaatccctgtttgcacagcaacacaatgtgtacattgttggcttaaggcctgtggtggacagaaagactctggccttagagtccttcaggccctcttatccaggaagagaagacacagaaacatcgttctcagagtagagacagtgtttctgagcgacccaagatttctcgtttcttcttgtgaccttcttcctcttttgggcactgaatggggtcaggcctctagggatggcacacagttagttggtgagagacaggaagggactcagggtccagcagctcctggaagggagaaaggtgacccagtaacttttcagcttcttttggagaaaaggcacagtgtcaagcaatcaggagaggaagaaaacaagcataaaatccacatccttaaagtccataaatggtgaaaggaaagctctctctgctccccaccaagtgtggaagttttatggtgtattctctattcatagggctgacagagagtgggactgacctgctcaggaaggtgaaggtctccacctacaggctgctgcaggaaagagctcagtctgcctttcctatccttgacaaggggagtagagccagttttcagaggctatccaagctagggttgacttgtctcaggactcatctttatgcaaagtctgcaaaaagaatttgaaattcatgaacatctgaccactggagaaaacctttactggctcaaaaaataagtctctgtggtttaattagctaccccttcggatattgatttttctagcacttgtacagaatgtaactcatcttccaaactttacggaagagccaacccaaatccagctggatttgtggctgtagagaagttgcttgattttattaagcatggcttacgttctgtctttctctctcccctgacatttatatgtaacttgcaaaatccaaaatcacagctagagagaagcaaactcttcccccaaaccaaatattttccctaggtctatcccccttagatcatatagtctgagggcacttctgatggcatgtgttacccatggaggctttcttctctgttgctctctcctccgtgctcccatggcacactgtatataccacttgctatggcctaaatgttggtgttccccacaaatttatatgttggggacctaagacccaatgtgatagtattaaaaggtggagcctttaagaggtgattaagtcatgagggttccacccttatgaatgggattattggccctgcaaaatggctccagggaaccaaccagcacctttttgtccttccatcttctgtcttgtgaggacacagtgttcctcccgtccagagaaagatacagcaacaaggtaacatcttggaagcagagagcagctctcatcagacaccaaatctattgataccttgatctgggacttcccagcctccagaactgtgataaataaatttcctttctttataaatttcctagtctcaggtattttgttatagtagcacaaatagactgagataccactatggtagcacttacaaccctgcattataattgtctctccatttaactgtccccagcactagaaatgtgaactccttgagggcaggagtggaatcgggttaatctccagatccctagcgtctcccatggggcctgacacatagtcttaacagtatttgttgaattgaattaaattatttcagccctgagctgtacaagctgtcatttgttctgcaacagtcagtcgaggacagctagggagcatgaggcaaatcttttcaattgtggggaagcctctgaatgatctgtttttgcctttttcttctacccttctcatcgattccatctatcccttttcattactggttgcctgcaccttgtgcaaacagaagtcttaaacagtgcaggatcttcagtgacttttttgtcttttgatccggggctgatggcttttcattttactcatgctttatatggcatagtcaagtctgattgagacttatttggtggtagggcagtcagaattactggtagaaaagaaatgcaattttattactttcaagttcatagaatgagaagaagtagactaataaagtctgtgccaggaagttttgccaagtagaagtccttggacttgttttaatgaataaataagaatgatgtgcaattaacatacttattgtttgtaaattgcttctaaagtgcctaaaaacaatttattcttgttagtttaaacattttccttgtaaccttgtttataccacaatttgcccagcaaacctttataaaaatagaaacagcagcctagctctatccgaatgctcaccaaatatgaattactgaaatctgaactgcaaaggtatgactccaacacgggaaagcaagtaagcctgagatggatgcttttaggaagtgagcagaacagattttcccttttctacttaggtgttagttgcaaaggcagaaggttatagttagttgctcagtactatttagagaggaaaaatgctcccttcaccagggagcaatacttgtcatcattccagctccccttggtggtctaatgccagagagtttctttccactgaggcagtaaaaatgagaaaatttaccttttagataatttcactacgatcaaacaatccccagtgggcaaaactaatagaagatactgtattttgattgcagtttatctctagcaattataaatgagcaatttaagtggcaacaaagcaagttgtttgctagaatgaggccgtatttcacagagctttatcattcaatattctctggatcactcagctaaaggcagtctatttccttgggtggatcatacatcctctttctacagtatccctaggaacaattacttttcttaatgatagggtattgagaagaagtgatctacaaacataatttacactaattttcacttttttcctcccatgagaaatttagttgacaagactttgagtattaggttttattcttccaggatttcttaagagaactaacaagaaggagctgggcaagtagagagaatgtcagaagagctcagttctgaatccatgcctgagtttccaataaccagctgcgttgctttgggggtggttgtaagtttctctgggcccatttccttatcttcaaaatattgtgtgtgtgcacgcacacgtttgtgtgtgcgcgtgtgcaagagagataatagattagatgaactctaaggtcatattgaattttaatgctttacgagtatatattctgtgattgttcatgagcccaaaggggaatttttcagtttttcaaagctttcagtggacagcatagcattgtcaggttgcagtaatgatttcgagaacctttgcaaatgactacatttggcaataaagctactgtaggctctaccatggcctgaagaaataattaatattgcataaaaatatatattttttaatttatgaaggatagatctcaaaagggactatagattgaaagcagaaacagtaagtgagccaattgggcttccattttctactgtttataaatttagactgggtggaaggtcccctggtttggaaagaaggagtcttaggttcttgctctgactctgccagtaattggctatgatcatggattcagaaacttttgggcctcagtttttccatctgttaaaaggggaaaggagtattttgcctatatacatctgcagactgttgtggttattagaagggagcataggtcaaggctttgtaaaaaaaaacaattgctatattaatgcaaggtgttatttgagaaaataatttttaaaattgggacattgagatacacagttctacaggtgtttctcattgtgctagattgtgaaacattgtctttgaaggtgtggattatatcatgttcaatattatgtatattacacattggcatttcaatggaatgggaatagagggatggggaaacaacattagtttggttttgacttaaagccagttttttctactaagttcttgggaaatgttgaaagaaatacaagtctaggaagcacatcagcctttcttaaaagagctttgcaaactttgcatttctgattcaatctatgaaagagacaggtgagaggttcctatcagctgttaatcagttaaccaacagtgggtgagcatttagccagtgccagggacagtgacaggcactgaagataccaatactaaaggtgtggttcttgcccttaaggagttctccaacctagtgggggtgagatataactaagcaacacaatgtgttaggtgatgtgatagaggtaagtatattccttatatttccttaggtaacatttcagaaccggcgaatcctgggtgacaagcctccggtttctctctaaggtactgctgtccagtagaactttctgtgatgatggaaatgttctatgtctgctctgtccaggacatggtagccacatgtggttactgagcacttggaatgtggctactatgattgaaaaactaaaattttaatttaatttaaattttgtgaatttaaatttaactagctacatgtggctaatgtctatgctattggacagcacccccctgaggaatggtagtgtgagcccacagtcaggctccaaggaggtcctgagttggatcatagaaagctctggtcaatttgcccctgtcctttaaccctgttttcctatccaaatactgcactagcccttgaatggctcctttccagccgacaactctgaattatgcatgctaatgtgtgttactcaaccatggcatgaggttccctcactcccctcccccaaccctgccgtaaagaaagggtactctgtgacagttcaatcatgatgaaggaagaaaatgggtcgaagaaaactagtttataaaagcttttaaaatgtctgaaatcttgcttttcacataatttcagatggtgtgaggtaatttcaactctctttaagctgagttttagctctctttctctctccctctccctctctctcacacacacacacacacacacacacacacacgcacgcacattctacctaaagtgtctgctgtggtagatggggctccttgtattcctattgaatcagcaattagagaagttgggtatataatatatttattttatatatatattatttatatatataaaataaatatattatatataaaataaatatattatatataaaatatgttttatatatatttatcatgtacagaatatatattatatgcccatatatatatatatatatatatataaaacttcccatgccaaaaacacaactcttcatcacattattctttttctgatagcgtagataaagggagactgagataaaatatcctagtaggaaacctcagaaagaaaactattcacaatattcaatgggagtttagttggacatagaaataaatattcagaagaaatcaagtttacgacctggtaagaagacttgccatttgtctggtgattcacagttttggaaagtgcttgcacatttggtcctaaaaaaaaaaatcccctagaaggtatttgggacagatattatttccattttttttttttttttgagatggagtttcgctcttgttgtccaggctggagtgcagtggcgtgatcttggcttactgcaacctctgcctcccgggttcaagcgattctcctgcctcagcctcccgcgtagctgggattacaggcatgcgccactacgcctggctaattttttgtatttttagtagagacagggttttatgttgggcaggctggtctcaaactcctgacgtcaggtgatccgtccaccttggcctcccaaagtgctaggattacaggcgtgagccaccgcactcggctgatattatttccattttatagattaggaaatcaagagtcagagaggctccatgatgtctgcaagggcacacagctagtaagaactttttctattttcatcttgaaggctctgtgattggaggctttgtaggatttttcttttacatttttttcttatgtgcttttttttttgaagcttataaccatctgcaagaaacaatcaccagagtaactttttttttttttttgaatcggagtctcgctctgtctcccaggctggagtgcagtggcgcgatcttggctcactgcaagccctgcctcctgggttcacgccattctcctgcctcagcctcccgagtagctgggaccacagcacccaccaccacgcccggctaatttttttttttgtatttttagtagagacggggtttcaccgtattagccaggatggtctcaatcagctgaccttgtgatctgctcacctcggcctcccaaagtgctgggattacaggcgtgagccactgcaccgggcccagagtaacttttgaccctaaatgaagctgggtctaccaggaaccaacatttaaaaatacctatacacaaaggtacatcattgtttccttcacaaaaattatatataatatacgtatatatagacacacacacacagttaagaaatgactgcccacacctgtttctactggtttagccccgataaaagtgtttctttgctatcaaatagacacaggtattgagccgaccaggatgaggaaagggtgtaccagcttccttcgagagaaaggtgtgtacataagagtgaaagaagaaaggggtctctaaacatatttgaaaaattgaccaagagagagctgtggagggaggaagctgagaacaatgtggggaaaggaaaggacacatcaaccacactggttgaggagtatgctgtctgacacagtacagcgttatgtttctgacagtgttaacttttgttttttgaaagttaagtttaaaattggtcctgatttttgctgctgggagtctgatggtagaggtagagtgaggtgttcccctcattatttcatttcttaatcttcctgcaggaggaaattgctctggttgtgttcactgcctttgaacctgtcgtgtttaagcaggctagtgtattttttttctcccaaatagtatacctcgtcagccagtcctatttactttgatttcactgcattttccagaatcctaatgaggtgtggcctagtggtgtgagcgcaggacctggcaggaagactctcaaattctagttgcagatgctagatgcttctatgtagtagagggcaagtctcttgacctcttctgtaatgccgttaacagggttaataatatttatttagctcataaaggcagcagggggattaaatagttaatgttgtttaaaaggctttgagaaaaagaaaaggcaagtttttttgtattgtgtgcattttcaaatgctaattcttattaacaggaagcatctgctccattacggtcattcagcacctcatgaaagtcttgctggctggatgggaaggaaaattcttcaattttgtgccatgagatctgagaaaatgtagctaccttcagccccagttatgaacttggatgtctgttttctccctatctaaaaacattcttcttctttatgtggtttttctaaggtttagtagtttttctctcttttgcaatcttttatgcttaccattactggtgcaaaatgactattgtgtttcagctgtggggggaatgaaccctttttataataggcagttagacattctggaagtctttgtgataaaagatttcatagaaatacaaggtgcttcagtaattgttctgttggtgccttgcataactgcattacagatttctaatactctggcagtttcaagatgctgatgatattagccactttgtgaagggtaattatggctttctatgcatggttgccagcactctcatgtcagattatagtagccttttggttaatctctattttaaatcagatcaaattctaacccaccctcatccctcctcatcccccttcccaaataaaatgagaagcactgtgaggatttgggagaaggacaggtggggtattttagagaatgagaaaacatttctattattattttttgagtcatcttcttattgcttgtcagttatggtttatgaagtgatgccaaagtataaggtctatcttgcctccaacgctgatttgctgcaatgcttgtttaagttgctagaaactggaggctcctgtgggtttccttctgtgcctaataatttcaacagagccaaatgccctttatttactacagtcataattagagggctgccagtgttaagcaaccatggaatctgagtttgagaaatgtttattgtgcctcattaaatctgaaatgagtacttaaaggtcagaaataaataatctgtttatattttttgtgacagtaaatataagtgaatgctgtgtgtacatatccttgactctactcatttcagtgtactgagacacccctctgtttgccaaggcagtaatcacaatatctgcgacaaaagagaactatggcaggtttcattgatcacaaacaagaaaatgatctattgtattgtatctaattagaaaacatcaatattagaagctaatgcattcactgtttccaagatggtctatcacttgattgttttttgtcagcatgatcacattttacgggcttgagcaacaagctggtacaagggaaatgaatttagaatgatatgccaaaggctgttgctccttcagtcttaaataagcttgtagaggcaactgggtttttagtggcacataatataaataatgggattggggttggaacagaatttgggggtgttgttttggcccaaaggcacaaggccacccaccgctttctctctaaatattttgaaagtcttttcagctgacaaagcttactcaatagaaattgtactctgcacactccgcaggcagtcagggctctgtagctggtaagtggcagagaactgaggcactgatataatagaatttagcagaaaggaatggaccagctcaggttctgagggtgctagtccttctgtgagccagaagggctcaaaggtaggctggatccaggagagctcatactgtgggtttctggatcccattgcttgtgggagattacacagacacacacacacacacatacacacacacacacacactcttatatgtgtgtacatatatgtatatatattatgtatatgtatatatgtgtatatttatttctttattagagatgggctctcgctatgttgcccaggctggtcttgaactcctggccttaagcgatcctcccacctcagtcttccaagtcattggggttacaggcatgagccacaatgcccaaccctcttgtgggagatcttatatgggtttcttattgtcagtttgaccagctttaccaaatcatagcttctaaaattgaaaccaccatcatgactattaatcttacatcttaggtcaccttctaacaatggttgccattgcctctaaagggcaaccaaaatggtcaccaaggtttcagggaacaaagtggctcatttctggatcccttgggctctgtgagtaggccctccagctaggtctggagaatgatttccagttagtgtgtgccaagtttttcctttgtctaactgctggactatagtcccctgactctttcattggaattagccaaggaaatcactcagagaaacataggtaggaagcaggctaatcacttccctgatgttactgttttctgattgcttcctatcccagtagcagaaaatgccaaaaacggtgctcctggggtttctcttattgtccttgttgcggcatgctctagctgagttagtacttaatgtggctgtagcacttaacgtgtgtgtttgttttcatggctctttaaaggggaaataacagttggcacttgcttgtaaagtgctttgatatttggggatgaaaggcactctgtgcctgcaaaatagctttaatgtgttgtagttacatgtttggtagggcgattggactccagaatttgttccactggcaaatgtggttgagagctatttggttctccattaagttctgtttacatgggattaaatagtttgacttacatgactgaatttttcattttatttgctcttgaggtactcttactcatactgagatattgttgattctgcatttgtacatataataggcattaactggttccagagagctttctataagcagatactatttcagagtgcactatgccccacaaaggacttagaaaagggtcgagggccttattcagaagcctgtatttgttttatggcatggtgtttaagctcgtctttcagcaggctttgaattgtatggtttactgcagacagctgctaggtttctcaaggaggcctctgtagtgaaattcacaactgggttgctcttctaaaggcataactttgacccaaagatgagagcaaagaaaagtgctttccctaagccatctttgccacctctaggtagggtgaccacatcaatggtgccagtgaaacaataggaatgacgatgagaggctgctaggaggggaattctttcaatttaatttgttgaatgttaaccacatggcctgtgtttctcattgatagtcctgtcctgacagtcactgggatgctagagttgtttaccacctgtagaaaagtagctgccacactgtccgtctgtgactcagaggtctacattctggtgaaccctcgtcttctcacagaaacgctatcaaattgggttcaggaacactatcatatgttgtcaccaccattcccagagatgtggcaggactgatggagttagatgggcagaaggcacctaactgtgtcatcttatccctttcagttatatataggctattgtgtatttataaggtagtagttgggagtgataacagtgaacaaattgtaactacagaaggcagtgtgcagagtggatgctttctgaagaagtagaaccaccttggcctaataaacttcgtcacctgccttaattgtgataagtagcctcattcttaatcccttccatctcttctctgatcattcattgatgcattatatgaacgcatgctaaatgtttagcgttgtggcagatggcacagggacctcaaaagagagcttccagtcccgttgagggatgaactgacacactacacatgaaataatcatagaacctgaggaaatgcataattacattgtacagtctgtatacaaagtgctgagaaaatgctaaggaacgtgggatgatcagtgatggagatatattagaaatgagggaaattagatggcttgtgttggatgactgcttagctaaggacttcatgtagatttaatgttaattgcaacaaggagctactgtaaggtcttgaaaagagaagtgatgtgatgaaaatagtgggtgaggaagattttccaaacagcattttgcagaatgaggtagaacaaatgcaggtgagaaaaaaatgacacaaggtgatgaaggctgtggaaatggagccaaaaggacagataatatgggctatttctaagaacgttatgaattgtataacctatttgataggatagggagatttcttgccttttatgatgggggttatgtacatatgacacatatgagggccaaattctcccatgtgagtcacctacagccattgagccattagggtgttatttagttctacaaagtagcagtgtaattctccaagttgcagtccagtagcctgcgtacaagtatatgcctgtatctgcaggtacataggtgccagtctgtgtatgtgtatttacctgaatgtctgacattttgatcatctctggtaaaagatccattagtttgtgagctccttgaaggtgcaggctatttttttttaattcccagggtttggttcatgcttactggatagataaatgaataaattaagaatcactttgttttagaagcctagaattgtggagcttgaaggcaacatggagtccttttggttattctcctcattttaaagaaagataaattaaggcctcaagagggttaatgtgattcatccaaggtcatctgtaagttaatgacaatcctagggagagaatccagctgtccccactataccacattgctttctgtagtcaaactgtgtgtgtttgtgtgtgtgcgtgtgagtgtgtgtgtgtgagagagagagagagaatgaattagggctggggtgtgtggggagcatacaactgacaataagtggttagtaggagtttacctagcacgttttctagttcagggcaaatatgaactttgtaatgttggcagctggggatggtgccttttattccaccttcactaattcctgcttcagttgctgctgtctggatggatgagtctttgaatatacattctagctggaggcacgtcagctttatttttatacagaatttgcatattcatttttatgtgttgggggtaggaagtaggcaaaaactatttattatctcatttccaaaagccatctttgtgaggagatgaccatttgaacatctaaaacagcaaccagctttaggaaaggttatgtgtcttttcattatggatcaataggcacaattatcattattggaagtcagcagttaaaaaaagaagcagcgttttataatcactttgttgtgtatctgatacgggattccagttttcctgttttgattgctaaaatgacttaagagttaaaaactttaaaaaattaggtagcaaattatagttataatgcttttcagctcgatgggactttaaaagtgtaacttaaaagttcgttcattttcaaatgaaaatctaaagatttgagtaacctcagttttaatcccaatgtctgcaaccttttttttttttgcttggtatagtgacctgggatttgtgccactggacaaagagtctagtcctggatatctgcatttattgggcttccttctccttaggtttgaagtctctctgctgataaatgtggtgctgagagagctgcagtcactcttctagagactagggcacgattcagtgaactgtaaaagtaatgcaaaatgacaattaaagtagggcattctctggtaccttgggggcctgacaaagtggaagtatttgacttctgatatgccagacttactaacgtagaaatgtaataacatatcccccacccaaacgtcttactagaatcctcctatatccagaagggacctgagaacagcaagtagtaagcaaagaaagctcccaagcagctaacaaacaaacacagaaacaaacaacgaaaatcaaaacattgcacaaaggtccctatattaaagatcatgtgatttcccccttaggagcgcaacatctcagctgtctatgcagaacgttacaactcttttttttctagacacaaatataattgtatagtttccaagaacacagtagagtaaaagcatcaaacttgaaatggaagaaaagctacttttgatataccaacagcactgaaaagttaaaaacgctgtgtttgatagaaggttggtgacgatcctatgttaaaaattaaagacaagaaaaaaaccacagcagtttggggtccttgagtatacaggcaaaatctgcatggggtaataatttacatttataaagatgctcctaagtaaccaataagtggttaaattatgttttttataccctattttaaggagggcaactttgtgatatgtttcagaaacaaggcagatggttaggattttaaatcaaagttttggttcttaaaggataacaccctaagctatctggaaaactgagctgtctagaattatttattgtttgagaatttttaaaaatcaacattttattaaacctaggtcatgtgagacacctgctttcagtgttatacccaaggataaagaattcgaattagaaaaagaatttgtgataaatatactaaataataagaaagtgactcttatttaccactgagatgaaataaaaaagtttgctctagacccatttttttttaatgtgacaattaggtttttccaaagcaaatgttgttcttatctctttgctgtgttcttgtgttaacctggctgtctgattagaaatggggacatttcctagtgaaattaatgtgacatttagagaaaatttcctctctcaaatgtttcatgttgtttgccatttagcatacttagagaaggtattggaataatgtcaagcaaattttgattaaataaggctaactaggagccaatacattcatgcaaaaaaaaaagctcttgtattattttaaagaatgtatttcttctgtggttctttatcccatattgagatgaccttggcaggtaatctgacaaaagaaatgacatcttctaaacagctgggcttgctttagaaaatgcagcacattaggtcagagcctgtggccagtcctttgctcaagacagttacttgccaccccggaggtacactaaaatttcctggaaagctttttaaaaaaatcacccagtgcctgggtccaattccaggctaattacctcagaatctcttggagtgggtccttggtgacagtatttttatttttatgttttacaagaagaagattctgagatgattctcatgtgtagttagggctgagaaccactggcttaagacatacaaactattcattaagaaaatatttccttcttcaggatgatctgatgatctgagtctcatcctttgctccaccagaagtgtgaaaaaatatactctctcagtgcacaggagttgggtttgggcatacaccttgaaccagtatgagctagaacacttgatgtcagtatacatagacccataatataatagcccatctatggccagttaactcagttgtttggaatgtagtactaatgaggccagaatagtgtattctatccaattagaataattctgctgcatagatttttcccataactgtaacccaactgcctcacaaagagacctgagacggattacaaaggcacaggacaatgggtgaatcagcatagccccatccattctgggaaaatcggttctaggaacctgccacattgactagcgctactaattgcattaggatgcagcatgagacatctgcccatgatggtttgtgctgatttgggggaatgatatattttcatttgaaggtcaggacccacaagaatgggtggtttattccttttggagttaaaaaaggaggataaaagataggaaggttacaagcttctatgatattcttctctttacagtagcagatcatgcctggcacatctgcctggggttaactgacctgtatttgggggaagaattgttaaggtaattactaacaagccctcgagacttgtctcttctcaactcagtgcctgggagtgggaatcctcatgatgagatatattatggcttaggaccaagaagtagtattttcattagtgatacaatgtgcatggtattgcttctttgcctgaacacgtggctctggcaccatgcctggaggtcaggtctccgcggagcttcatatttgatgcagagtgcacacaggttccatgccttcatttgcaaagatatggaaaattttctacttgagaactgtcttctttaaaggcagtaaagacagattctttaaatacagtagcttgggttgctgcttatccttttcctgcaaagccagtatcctctagatttcctttttgtatttttgtctctttaccaatcttcttgaaaaaatgatttagtttgaaagatgagatggaacatgcatgtgccactattttattgcctgaatgaggtcaaattcctgatcctacttggagttagttgcaggttctgtataaagcaggggatcaggattcccaccattcctgtcatgggtctgataaatgcagctgaaattctcctttggattcatgttctattatccctattttacagagagggaaactgaggcatgcaaggattaagtaatttgcccaagatcgcagagtgaaatgaatatttgaactgctgagtgcttaatcaattccgggttttaacagatgtattagtccattcttacattgccctaaagaaatacctaagactgggtaatttcataaagaaaagtggtttaattggcccgtggtcctgcagactgcacaggaggcatgatgctgacatctgcttagcttctggggaggcctaaggaaacttacaatcatggtggaaggttaagggggagtaggcacatcacatggccggagcagcaagagagagagagatggggaggaaggactacacacttttaaataaccagatgtgataagaactcattcactatcgagagaacagtaccaagagggatggtgctaaaccattcatgagaaaccgccaccatgatcaaatcacttcccaccaagccctacctccaacattggggattataattcaacatgagatttgggtggggacacaggtccaaaccacatcaacagggtagcataatttttgtggggtagtgaacttcccacttgttaaattatatattgtactgaatatcgtagatgaacacatttaaccaacatcatttttacctgttatgttggtacaacgaattaactcaaagagtgtttgttggttgactgactgttggataaacttcttccagcaaatacttggattgtattcctaacacagcttccaagtttgcctcctattcctgtttgtgacaatttcagcattcactctctatgaagaaaccagaaatgaactgacccttttgatttttaatcccccaacccatgcttccaatagcattaaaaattgcttgagtttacattaaaaaggagatataaacttctagataaaagcagtgtgagtagatattacacagtgcatcttcaaatgaggggcatgggtgggcacatgaacatacctgagtaagtgcagggcaatgttggggtttagtttccttttaagtactgtctcctcctctctctcacacattcaccgtcccccttcctacctattgtaggcacttggggtctgtattctgactgctggctgtttggtgcccatgtggtagctggatctgctattgcctgttctgttttcttctccatcaaactgtgagctccttggaagcaagggctgcatctaggagcctagtacagttagtatctgacaggtagaggtctgagaggaatctgctcttttgtttgctagacagaaattgtgtttccttttccaaacactcccagttgaagtaatttcagaaggctcctaaggaatggtgggaacagtggagatttctagtgggatggcaagagggtgggggagatgtgtttgggtagtttctagatcatacaatggttcaagaagagtggtactttagtgctgggggcgagatccactttactaggacattcagttactttagtgtcgacttttctctggatttcacccttctaaggcttttcccctctagttctcccaacctctgggtgatcattagctgtttttccatctctttcatctggcaggtattctgcatttgcttttataaagccattgctccagcagtctgctgtaaccagattaaacaggggtgctctaatgataggagctgagacaggggtttgcttgcaaacttcatgtttcacatgaaaggctttggcaccccctgtggactgcccttcaccctgttttaggcatagtatttgtttgcttttgtatctgtgataaaacaaaggccttcctgcataaccagtgctgagcaaatgtcttgaaacaaagggaagtgcagagtttaaatccacagtggtgtattaccttgcctgcatttccatatctttggaataaatattttaacatgttaattatctactactaataaaaatacctttgaacttccagtcaatttgatgggccatagaattgtctccactggggaatgggaagtaattagtttctgtaaggattgtaggtcacgttgtctcttctcagtaagtggttgcatggtcagtagccagtcatattctagggaatgtttgtgccaaggccgccctggtctgcagcggggagctgctgcctccacggagcccctagggcctgaaggaggcagaggctgctgctgcactgtggccttgggttccaattcactcactgcttcttgacccagaagaaaaattccttctaagtagggcagttcgaaatctacttatgaatcatctgtgtaacctttttaattttttcttctcattgcagactgaaaactattcttttgactccaactacgtgaatagccgagcccatttaatcaagaggtatgttggtttgcttgcttattgctgcaactaagcttgatttaacattaaaaagcaaaacagattaaaatttttaaaacgtatttttttgggggattttaaaatgaatgtccaacctactatttgtagaaagtttggaaaattgagaaaagcataaaaaagtaaataaacatcactggtaatttcatcaaccaaaggtaatcactgttgacattttacatttcttggtatgaaaatgtacgtataaacactcaacaataaaattggaattatattaaaatatagttttatctagtgacagaaatctgatattacaaatattcactatttctaatatttctaatttctaatattatttctaatatttctaatgtgatattagaaatatacaatagaaaactttcacaatcatgttgataccaaaattcttgttgctcttcactttaaataaaggaaagccttaaaaatgtttttcatgtagaacttcccatgagttttgagattgatgctatttcaacaactttgaaatcattttaaagatattttaatgacagagaagccaatcctttcctttctagatgagagagaaaaagaaatttgcctgattcttcttaaaatttttagaagtgtttcagaggaaacattcaaagttgagatttatgtgattggttgatcataatttagtatccaaggagccataatggatgtgagtacagagctgaatcctgccaagaaagatcccatctggtgcagtgggctgcacccaatgggagaaggacaaggggtttgggaagccctctaaaaggtggaaactgagcaaagaagagaacctcttgcacagaaagaccagtcctaacctttcaaatgatgcctgtattgctgtttcatgtaaatatcacttaaatggtccagtggttattctgcagctaaaattgaactctgagtatgtttgttaaaataatagaaatgaaacagagaggccagcagggtatgttagagctgtagcagagaaggcttgcaaattgtattattttgctggctctaatcccataaatttacatcaccagaagagtagaattcaaggaataaacaagcttcaagtaacttgcattcatgtctgatttaattcatgaggcttcagtaacccctaaaacatgctaagtttatctgtattggtctggaattgcttgtgaccttaagtgatgatcattagttgtctgaaaatgggtagcccttgtattatcagtgaaagcacagttgagaattttttttgaggggttgggaggaatccatttagaatattttcctgggtcacagaataaaagcaagaggtgaggaattcaaaattatctgacgaatttgttttagaaagaaaaaaataaccctcttatgtgcactgattagagtgcctttgtagcagaaatctgctttgtttctgcttccgaattgttattttcaaagctccattttaaaactttgataaaaacagtgacttgccttaccctcacaggtccctcgggctaactcagggtacctgggaattctatagccaggttaaacagataacatgatgctgggcgcagtggctcatgcctgtaatcctggtgctttgggaagctgatggtggagaactgcttgaggccaggagttggagaccagcctgggcaaaatagtgcaacccctcccccccaccccccaccatctctaccaaaaagaaaaataaataaataaaataaaaaaacctgatagtatgagtctgattgtcacagcctggaagaaagctaagactcccagggacccttgcatcttacatcagtcctgactatccaatttacaaggtagactgatagataaaaacttatgtttgaacatttatctttggggatacatgtatttccacagcagcgttgagacttactgggaacctctgattttggttaattactttatatgttttttgtttatagacacatacacacaaaaggcacaacctagacttaatgggctcttggtgaaaaagtctcctgattttgcatgaaatcaaagatagctttttcttcttttttttaaataaaaccagggaccaccttgatgaagaggaaacatctgaaaactcagggacacatgcatttttgccagggttctgtttacagagccatgagagctttgggaaactctgaaggccttgaatttgtgtggtcaattgagtttagatgaagcataatacctagaaaaatacagggaatcttgtgtgctatgctgttctggggaccaactgtgttaaatgtaaaatgtgtggaaaatgttgagagtggtggctaacaccaggtgataaagtcatgcgaagcctgttcaaatagctcacaacagtgtttgaaaagggttttgctgtatgtggtttcttgaagatccatttacatgcatggtaaacgctcttggccaggaaattctgaatctgattatcagttttaattttactatcaagtccctgtttctttgaatgccaatacaatacaatttcaggctaactttgagaacttctttttctttctttctttctttttttttttttttttttttgagacggaatcttgctctgtcacctaggctggagtgcagtggtgtgatcttggctcactgcaacctccacctcccgggttcaagtgattttcctgccttagcctcctgagtagctgggattacaggcatgcgccaccgtgcctggctaattttttttttatttttagtagagatggggtttcgccatgttagccaggctggtcttgaactcctgacctcaaatgatccacccaccttggcctcccaaagtgctgagattacaggtgtgagccaccgtgcctggctgagaacttatttttctatccatgttctcttcttctattcactttctacttatccaaggatgtttcttggacccttcttttcggcattctctagcagttgttagcattcttagccagactgtttacatacaggcatcttttcctcttttacatctatctaccttgagtagttgaacagcagctaccactgtccacctctggttctttccttcatcagtcagggttcctacatgaaatagttggcacgcctaaattggaatggcttgaggaaagtttatttacaaagaggaccatttacaaaggcttgggcacggttagtgaacctcaagggatactgcagtattatggcactggaggagctaaaaatacttcagacaggaccagggaagagagcatgtagggaacattgacttgagagtaacagtgacttctggttggccaagggatccagtcatcatgaagtgaccctggaggaagggagcagagacaatcaatatcctgatatcactgtcctcccctgctctgatctcccgctgatgtcttcctttggctaaacccaacagaaagccagagggcaagggggttctcataggcacaaatcaaggttgagaaggatctcaactgtgggaaaaggaagtgatatggcaggctccccataattttatgcaccaaggaatctagcattatatttctgtagttttttttttttccagactgtcacttgcaacccgcaggtgtacccaaggaggcttatgtgagggccccagattaacaaatcatggcagtgcagagtttcttctgaatggacttccttcctgctctgtttgtttcttgctgtcttctcagagcaaggaaagccagcagtggtactttgtcgctgctgcagcactctttcctcatgcctgttttgtgggctgctgtctgatatccactcctacagtgctttgggaacaatatcaagcagggcataaggctgtggcccaaagaaaatgaaataggaaatgaacaaagcactgactcagcgtggaaaggattaggagctttggctccctaaatcatgcacaatgctttctttttccacccaaattgtcctggggtttttccagcacttcgtatggtgccttgtatataataaatgcttggtacatgtttattgaatgaatgcatgagagaaatggaagaaaatcttagcatttttctattaaagactagcactagatttctctttaagccagtgatttctggattttaatgtgcattggaaacacctggaaggcttgttaaacgcaggtatgctagctccatccctagagaacctccagttgtaacaggttcccaaggtgattgtgatacaggtggtccagaaaccactctaggattttccttgtattacttaaatacagttataataatcttcattctcactccttgctcattcttagcctcagatatcattccctgggtatgtagtatcacctactagtaagatataacctgtttccattctgagtcttatgtcttttggaaaagagttctaatatttcagatggtaaatatgggtcagaatttgtgtgatgttcattcgtcatgcatctgctgagtaactcttctgtgcagaaccctgttctaggtgttttcaaacatatctgtctttttgttggccaccagagcagtaatagaaacatgggcatttacaataccattggaaacaggaacccctaatttattgtcccacaaaagttgttttacaagtccttcatctcccaagaggtatgcaggtaataaagcaagtgaaatcagcatttttatgcctggcataaattgttatttgttttgggtgagtagccatttaccaggctattttacaatatgtggcatcttgctcactgggtcttaaactgccttacacaaatccattcattaaaccactaaatgctcttacaagatcagtgtaagtggtgcttagtttgtcagatgggcaaactaatctttaaatgagttaactattccaaggtttgggggagttgttataccttgctttttgttctgagaatacacaacttctcgtgctcacactaccagtcccttacatcctagtagctaatccttcactgttttattatttccataatttctattcaaaaagcaaaatctctgaggttgtttgtaacattcagatgcctatgaaaaagatgatcaattttttaaaaggcagatccaaaaccaattaggagaagtaaggtagacatccctggcatccagggaggtaactgactgcaattaaacattacatttatgttgaagtttttgagaagtgaagacaaagcagtaagtacaccaagtgatatagttttaattattcattaaaggaaggatggccatttgacaggagaactattattttctgttctttaatgttagaagaaattaacacacacacacataatagtgtgtgactattgtttacagaagatatagaagtgttctttaaatataaattttctgtaccaatcctataaaaactatggacataatatttaattgtaactcagtgaaaacattactacacagaataatgatggtattaaacaataaccatttatggagcatctatgtgtatctggtacttcatgtacagagtctctttgagtcttctaaatggccttgtgaagggggttttagcaaacacattttacagataaagaaactgagattcaaagacatcagatatcaggtccagggtcacacagatgaagtggcagattatagattattacttgtcctaatgactccaagttcagtgctctttactacagtctgctatagaaataaagaacctagagcagttgttctcaactgtggggtgatttggcaatgtctctttggagacacttttggtttttttcctttaagtgggggtcactactggcatccagtagataaagggcagggatgttgctaaacaccttataatgcacaggacggccacaacaaaggattttgtagccccaaatgtcaatattgccaaggttgggaagccctgctccaagggctggttaattacattgcccccatactagatccctcaccatcatatgtttcaagcaagtttcaacagctgctgaattcagagttgaattctctggcttaaagtgacaactttgtgttgtggattaaggacattttcagataccagaaaatatacaggttggaaagttaagtatttgttataaaaatggacctgaatatcatccaggcaggtcatttcctttctccagaggtacaggggtgcttgtaggcaggcactcacctcacgtgacagagaataatttctaaaaaacaaactttacatctatttaaactgtgggattataatagtatttacagaaaactccgtaatatgtgccataaagctagaaatggtgaaacactttaaatcatgtgtttccaattggccatcatggccataaaagaactgtaagataatttgcttgtttgtttgttttttaaagaacggcatcctggtgggtccataaggctgagttagctgtgtgacataaattgaaggagctgagtgagctggcctattgagtaattttaattttagtgcagttgatgctcagttattctttctgaaaataattagctaacaggtcaatgcttcactctctcctgctcttcattttcttataattatggctttccagttactggcctcctggtctttcctttttatattcaggtcagcaagcattctacatctaggttggtcatatgttaaaaatctgctgtgattcttcttgactaagtgtggagggtgacaatgtatccattgtgtccatggcatagctcttcattatatgtgctgaatcttcttatcagtctcagagagccaggcctgtgaatgtccaaggttgagcagatcaagtgagtttgcggtgtcatttccacagggctcttttctcagaggcataggtctattagggtttgtgttaattcacaaacatgccattcttccttgttgaggcaacaacacattttcttgagtgtgcctttgctgcttcctcaccgactagggaatggattcaccatctactaggtatttcagatgcataatttatggttcatggtgtagcaaagctggggattctgtcaggacatacaaagtattagaaatagtaggtgggtgccctatagctgtaccttatgcattattctccatttcatgagaaatggtgtgaagttcttggattgcatgcatagtgcattgtatggtagattgatttaataaatgcaagaatcattttacctatcaacacttgagctgaaagttttcatgttcttagtataactatactcagagttgcattagtgctcactctctggctctcacttttgtcttgccttctatattagtcagggttctgcagagaaacagaaccaataggcatatctaaatctataaatatgtagaaagagttttattgtaaggtatgggcttatgtgattatgggggctgaggaatctcataatctgccatctgcaaggtggagaaccagggaagatggaagtgtagtttgaaggcctgagaaccagagagccaatagtgtagattcaagtctgggtttgaagtcttgagaaccaggagcgctgaaggcgggagatgattaatgtcccagttcaagcagtaaggcagagaacaaactcaacttctttcttaatttttgttttattcagtccttcaatggattggatgatgcccacccacattggagagaattgtctgttttactgagtctgccagttcaaatgctaatttcttctggaaacaccttcatagacacacccagaaataatgtttaaccagctatctgggcattccatggtgcagtcaagttgactcacaaaattaaacatcacaccttccacgctcagctactgactctcctctttttctttgaatatgttcatctatttttctcagataaaactgacttactgggttctctgatcctgataatccttcctattttagttgcactacttcaatttctgctacctttgctttttacagttggttagtagacatcttttaagaatcagtgtacatagtggttaaatttctaggcaggctctggagctagactacctgttttcagtcttaggtctgctatattttttaccagctgtgtgaccttgggcgagttatctcacttccatgtacctctgttttttttcatctgcaaatgagaatattagtagcacctttctcttacagagttgtgatgatttcaacagttaattaatgtcaaacacttaaaacagtgcctcacgaatagtaattgctcagtaaacactagctattattattttactttgattttataggaagagaaaagtcttctgaaatgatgacattctttagaggcagttttagaattgtagcttcttccaccttgtctgtagtgatgcattgaagataagtgaacgaaaatattagctgtatcagcatccaatagtgggaacctctgtgcaatgttaagttttattatctttaagcacaaatttctcttccccttattcctaccctattggacagtctagccactgtttgcctcattacagagccgacatcatcctggctcagaaagatttttaaaatcagatctgtcacggtcgtaaattatcattctgtcttcaacccagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatggtaaggactggttggatgtaagttgcagcaatcgactccaaagaacccaaaatgtttgtaggcacactatactactttgcttaatgagtgtattatcaaggtgtctacagagctcacacctcagcagcatctacaggtttttgagatgtcctgacacctagccagattcttctttgccctccctaagtggatcccctaggtctgtataaagttcaggcactttagaagctgactacatgtgcatattacatacattttcttcaataaaactgcactgagctcataggagatgaacagatgccttctctccaggaataaatgcctatttttgctttagtacatgaattcagctgatcaatcgaattgcatagaacacagcactaatgagaccaaaggggtgggttttatttccctatcagactggttagctttacccagagtgagactctgttctctcattacagattgtgtactatttactgaggatagaaaataccaaacttcccattttgtctatggggctgctatgccaaatccctccctctagcttccacacaaaaccatgccattagtcataggggagaccagggtaagagaacgtggctgagtcaatgtaaaatattccgttaatgtgaaaggcacctcaaagcacatgtcaggagtggcatcctcatgtatgaagaagagtctatttctgtgaactcggaactcagccacacatgctttatcgagaggcactatttaaaactttgctaggcagaagccagggtataaaaacattagcagagttcagctaaggcagaatgtttagatggacttgggcacaaatgtcattttcaatattttactgatgcaaacatgctatgcaaacagcctgtctttttcaattaagaaatatgaattcaacttggtggttaggctcagtgaagcttcagaatgcttggctatgtcttgagaaaagctagactcaagctcagctggaagccctactgctaaaagacttaaaaatgagaaaacaaaatatggtgattatgtgctggtcttcagctgtttcatttcactgtaaacatcattaaatgcttttgttttggtttttggaaataagtccaaaggaaaaaatgtactatccacaaaacaaaatgtttttcatggaaaaaaattagtcactgtagattctattaaattgtcttaatccattccctccccagcagacccaagtgtcaaagtctattatatagagaggtcactatgaattgtgcactgctgtcttccctaattggtgagtggtgacatctgcagagataatacactttctgggaaaccttactatgactaaagatgaaaaaaattaaacagttatataactgaaacagagacaatttaatactcagaggattagcagtatgtcacaggatgcaaactgatatatatcatttactagttgtgtgtttcaaagaaatgctttttcatttatatcaagaaagggttttagttagatgctctctaaaatgaaatgactccaggaaaggaaatagtcataattgattctcactttatgcctggctagaacaacatctgttttatttttttgtcacatttctctaggaaaacagtatcagggaactgcagctagttttttctgagagagtgtttcttacaaattggatgtattacatatatatgtgtgtgtgtatatatctatatatgtgtactgtgtagattggataataagacgagtattcttttttgtgaatgcatacctaaattttatttcagcttagtcatttgggttgaaggtagagaccaccagtctccatataggtagagtgaccacataacccagtttgccttgtatacctcactttacatctgtgtccttggcataatcaataatgagaatattctaaaggaaatgtgtggcaatactccaagattcccctacatataagatgatgattttacacacacacacatgcatacacacacatacacactttctgctgggccattttggcaacactttcacattttgtttcttactatttgatttgcatgtgtgtatcttcattttttctattattccggcagtggttaaaccttgagccaacccttgagtgagttcttttcaacttgtgtgattgcctaaagtttaggtacaaaaagaatttgggccttgtttatacctcagtctctcccttgtgatatcccactacttctgaagctttctgtaataatacttgtgtgtcccatagcaacttcaggcttgccacagattccatcaccagttcacttggactgatactgcaacctcaaaaaagagcaacaattccaacaattaacatttcatagcattttaatatctcaagtctgcatttgcataataagtatatcacattttatcttaaggtacagtggttgaaaggcagtcactgggtgatccaccatgcatgcctgatcttatagccattttagttagattgtcccagggtaacatggtattgttgcttcaaaggattaccaatttagaaaggtgagaagggaaaatagaatctgcactggactgagacctgtactgaaaatctcaagaattccttgaggagaaaaaaactagtccccaatccccttggttcattgacagtgtgatgggaatcttaaacccaagtgttctgaaattcttggagttccagagcaactgttcttgaggtttgggtaggtgtcactggagcagaatgaagaatgtagtgaatttgtcaggctaactctgatcctggtatttcttttagtcctgccagaaccactccaaagttgggccaaatgtatccaacaagagcgtaccttacacctttgttttggggagtttggctcaccttgtattccatgtctgtagttctctctgtgacttttctaatttggatattagtactgcatatttccttgcacgtatgtggacacatgattgaaggggaatctcagaatttcaaaataaagataattttgtgcatctgttagtttttcctttgagcaggaatggtttgttcaaggagctggtattgtgttgcctgtgtttggggtaaaggtataaactatatttgctcctctttttaagagatacctgggccctgtgcttttccacactgccaaaatttctatgggatttgtccttaagattttattgtagcagaagaatgatcggtgtgaatgacaagggtgctttgtgactctgagtaagggcccaaattccttaattttcagtaacccttctctgagaacattcctagaggtgggaacccagaatcactatatttaatgaaggaaggagaatgttatattcaataaaggaaggagaatatctagaagacttctttttttttttttttttttgagacagagtctcactctgtcacccaggctggagtgcactggtgcgatctctactcactgcaacttctgcctcctgggttcaagcgattctcctgccttagcttcccaagtagctgggactacagatgcgcactaccactcctggctaatttttgtatttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgccccgctaattttttgtatttttagtagagacggggtttcaccatgttgggcaggctggtctcgaactcctgacctaaagtgatccacctgccttggcctcccaaagtgctgggattacaggcgtgagccaccgcgcctggcctagaagacttttgaactcaaagggcaaaagtcaggtatttagtcactaggaagtttggattatgtgtttccttttcaatttttaaaaatgtctaaatttattttttattttgtttataattgacacatcataattttacatgtttgtggggtacaatgtgatgcttcaatacatgtatatgttatataataattaaatcggggtggttagtatatccagcaacctcaaacatttatcatttctttgcagtaatagcttttaagatcctcttttttagctatcttgaaatatacaatgcattgttataagctatagtcaccctactatgtatagacaccagaaggattgtgtttgattgtccaaccagacacattcgtgagctcagtgagggtggaaatgagagagaatgacaggaatctctgctttctggattactgtcaatcttggtatttctcttgacatgcctaagaccaggtcagttggttgatgaactggctaagctgaatttcctggttgccagctgactgaattacaaattgatttgttatccagtgcccatgaattaatacgtttcagtttgtccttagtattcagctcttgttatggcttcccagaaaagaagatgatagagaattctttatcctgtgctttctactggtgtattgtagaatggcaatttggaatgctgtctcttaatagctctgagtggcttgagaccaagtaagtgttgtcattggcgggttttaccacttgatttggttcttgaggcaatttggtgctgagcttgggagtcaacactcaaattttttaactgatgccttctgtccctgagggaattacttggcttgagggagtctgagttacctggtaaaattaccaccctttggtggggataagaattttgcctttatgcggttcctgcagagactctctaaaaagagtgattgacaagtagagtagtgagaggtgccagaggctcatgggtttgttgcgtgattaggggtatcatggggcttgaatttcttcctatccgggttatctctgagctaagtagtgggggctggggtctggctccttcttgcttctttgcataacaatttttgatgatgtggatatcccattattcttacttaaatatgtaatcctgatatgagattggggtttatagggatcatgccctagaagtgtacactagtcccaagctcagctattttgtttcaaattacactcagtccctctttccttatggttttaattattgattataaattcatcagatgaaaagatgactctaattgctctaatatgcacccaatttggagttcgctacaacactgaattggtttccctccatgctaactgataccaaatggaagcaacttacagaatttttttgtaagatttagctgcttttcatatccaaatgcgtccaaatgcaatataatgattgctttatttctggaagtatagattcttctgttttagtagacttgtttatttaccagtttcatcacctgaatagcatttaacatgtttgctgtgtataacatggatttgaagaacttgatctgtacctaatgcaactgctgttaacaaatttgccatgaaaatgttctgtaggctgcgtactatgcttattctagtgtcaaccacaggtatattaagatgtttacactttcaacactctaccaacaatatgtaattttgtttcctctagccatttaaagaaattatgattccatgactgaacatccttcttttatcttcttatctgtcccccgactcacctctctcctcactgaattttgaaacactcatttcaattagtctcttggcaaaatagggagttctcaatggagactattttgtgtcattgcaaagcagtgtgctgctgggctccagatatggtagcatgggccagatgttcatagagtaattgaaaattccattttatcagaatagcatttgctgtcaaaaagttttatctttacgtgaacaaagcggttgattagatccccctggacctgaattagcatctttgaggctagatacactgttttgcaattcatgtggttatttctttcccagttttgctcatatagagactttaaaaaatgtcttcatcctcttgcaaatatacctagtgaaatttaattacttgaacccaggaatgtgtatacagcgtttctatatatgtgatttccagctgctttcatcctgcctctggtatactaggcaggaataaaccatgaacagatatatatcactcattactcagtaatatttttgagtgcccactatgtgcctggctctgggaattgaatgtgtcaactactgctgttattgactgtaaaagttgttatctttttacttttattaatctggggtttactgaggtgaccaaggccagctcaatgatgaaatgaataattctattttaaaaaattataagaatagattttggggccattaaaaaccttgtgaatattgtgccagtaaagcaagagaagcaatatgaaaagactgttacaatcaagatcttattttcaatgggaatgtcatgaaatattcctcctttgatgttctaatttggacagtatcacattggtaaacatttttttttaaaatccacctgttgtgaggttgaatttcctactcatctttggttaatgtcattgtaggatgctaagtttaatctctgacatgtccaattaccttgctggtttagaggcagtcagtagcactcaatgcctagtacccctttttttctgatgcccagaaactttatcctttctctcagtctcagcagtttttgggcaggtaggaagagaggtgacaggtggagctttttcttttttttagttcaaaaccaattatctgctgtaccacataattggattttttccaaggcaacatttacattttattggaaaaataatcactaaaataaaaagttgttcttcactaatggaaacctccctgttgttagaatttctttgctagtattcttttggcatgggccctttggtcaaataattgttttaggacagttcaccattggtttcttcatgcaggacattaagaataatatcaaccgtttgtctaattttaaatagatacgctattgtgttatagcatatctatttaacatattgtgttatagcatattgtgtttcccaacatatatatatatatatacagacatatatatgtatatgtgtatatatatgtgtatatctatatgtatatatatcgggaaaacacatgcacacacacactatacacacacacacacacacacacgttggttatatatatgttatgcggttcctgcagagagtctctaaaaagagtgattgacaagtagagtggtcagaggtgccagaggctcatggatttgttgcatgattaggggtatcatggggcttgaatttcttcctgtctgggttatctctgagctgagtagtgggggccagggtctggctcctccttgcttctttgcataaccatttttgatgatgtggatatcccattattcttacttaaatatgtaatcctgatatgagattggggtttatgggaatcatgccctggaaatgtacactagtcccacattcctggattcaagtaattaaacttatatttgcaagagtatgaagacatttgtaaaagtctctatatgagcaaaactggggaagacataaccatatgaattgcaaaacagtatatctaacctcaaacatttatcatttctttgtggtaatagcttttaagatcctcttttttagctatcttgaaatatacaatacattgtttctttccatatgtatatttatgcttgctttcttactctctgtatatgtagtgtgtgtgtgtgcatgtgtgttttcccaatctacttggaacttttagttgtctgatattcaaggttattttaatatttattattactaataattacttgtggtgggctgggcatggtggctcatgcctgtaatcccagcactttgggatgctggagcaggtggatcatttgaggccaggagttcaagaccagccttgccaacatggtgaaaccctgtctctgctaaaaatacaaaaattagctgggcatggtggcacatgcctgtaagtccagctactcgggaggctgaagcacaagaatcacttgaacccatgaggcagaggttgcagtgagctgagattgtactactgcactccagcctgggtgacacagtgagactctgtcttaaaaaaaaaaaaaaaaaatgaagaggaaaaaaacaaacaaaaaacgaaaacaaaaacaacagaaaaaaaactacctgtggtaaggaattcattactcatcaaaaaataaatgccaaagcttttcttgattagttgacattaagaatttccatatttttaagcattttgaaagcattagaggatgcaggatatgtaaaaggagcacaatgaacaattaagaatttcattctccagtagtttatggcccaacagcaaaaatggtccagtatggaatagactacataggatcggtgaagaaagtaattaagatttttgagctggagaccaaaatgcatttaaaaggacactttggtgtaatgtgatctctttggaggaatggtggaagccaggccccaacatagtatgctagataaaattatgctctatttgggtgatttactaggtgaatgttttccagtagcttcatgaaaaatcaacttctataggccatgaaaagtagggacactgccaataagttaatagatgagagacaaatcaagttgttttgtgggactttccctttctttctttctttctttctttctttctttctttctttctttctttctttctttctttctttctctctctctcccttccttccttccttccttccttccttccttccttccttccttccttccttccttccttccctccctccttccttccttctttccttttttctctttctctctctcttttccccttcccttctcctccctcctttcttttcttttcttttttctttctttcttttctttttttgagatgggtctcactctgtcacccaggctggactgcagtggtgcgatcacagctcactgcagccttgacctcctgggctcaggcgaccctcccaccttaaccttctgagtagctgggaccataggtgcatgcttggctaatttattttggtagagacgggattttgctatgtttcccaggctggtctttagcccctaggctcaagcagcagtcctcctgctttggcctcccaaagtgctaagattacaggcatgagccaccgctcccagcctaacattatttctgtcctgtcataagatgattaagagccataaactcttatcaggatgggaaatgataaatctaaacatggattttaaatatttgtagagtatttttttctgtttattttcctcttaatccttttgttatgaaataaatatggggaattaagtccattcatagccagtttaagggattgataccaagcattttttttttttttttgagacggggttttgctccaggctggagtacaatggcacgatcttggctcactgcaacctccgcctcccgggttcaagctattctcctgcctcagtctcctgagtagctgggattacaggcctgtgccaccaagcccagctaatttttgtacttttagtagagacggggtttcaccacgttggccaggctggtctcgaactcctgacctcaggtgatccacccgccttggcctcccaaagttctgggattacaggtatgaaccaccgcccctggccccatagttttaaaagcaatttcaacaataccaaaattatgtatcatttatttattctgtggacaaaatagtcgtgagatggctttcctcttttatgatagatgctttttgtcatccagggtcaggacttgcccaaggtatttttggtctcttgtttttatcagatggctcagtgccctgtatactttgcatcaaggaaagcttaattgatacatccactttggaaacgtggctttttgacaagaaagcctttttaatttctctttctttatataaggcttatccccagtaaaactccagcctagaaaaatcattgtgttactccattctcacactgctataaagaaatgcccgagactgggtaatttataaaggaaagaggtttaattgactcacagttctgcatggctggggaggcctcaggaaacttacagtcgtggcagaaggggaagcaggtactttcttcacaaagtgacaggagagagagagaatgagggaatgagaaagtgctatactttaaaaccatcagctcctgtgagaactcactcaccatcatcagaacagcataggggaaaccgtccccatgatccaatcacctccctcccttaacaggtggggattacaggtccctccctcaacacatggggattacagtttgagatgagatttgggtggggtcacagagctaaaccatatcaatcatcaagcaccaaattagaaaaggtttgagctgctctttttaggaacatcagaaaagttgctttttaggggatcacacacaggttcttcttctgggcatattttcaaagatctgacataatctaggcttaggtcttagatggacttgtaaagctcacagtggatagataaaacagactcttttgcaactggacaaagtggaaccccatagaccaatcattctgccaggtagagagaatataaagcagttcctcatagtttgcgatgaagagattattaatgaaatatcagtctccagagctgttttggagcaaatcctttgggactgtaagtgtgtgtgtgcaggtgtcaatgtcagaagggtgctgtaggattttaggttttgtggtaaacactggacttcacttaacaatgtgccattcagagatctaatatgtggttggaagtatgtgtaggatggtgtgtaaaataggtaattcgaaaggcagtgaatctggaaggggccaaaagaattgatcagaaaatgaactctttgtgactgaagttactcaaagttttgtcacattgaggcggcctaatgacaaatacttttttcttttgagggtctctggtcatcagaaacaatagttgtacttcattatccttcatgacagtttagacaacaaaaatgcaagctattaaatttgaaataatagacaaccctgttttatcattagtttagttctttttaaccttagtaatactcattttaatggcaaataaggctctttaggttactgccttagtttaacaggaaaattttcaatctggctaaagaactctagagttttagaactctaaaagcaagtttatctccctctgcccccagtaagctaagccttagggcctttctaaattatggtctagtccctagactctaagtaatgcaggactgcaactgtaatctgctttgaataaaaatacaacttataatgttgctttctttttaagtagaaatctgtaaacatacagtactctaataatttggagaaacttgatactcttgcagcaaggcagcttccaagtcatgggtttgcaaatccaagtccaatgccagagatatattttccaatttctgtggtcgcttttccacctctaagctcatatattctctccttttctatccttaacttgcataataataaatgtttgacaacttgctttctttcctcctctttcagtctctatggagtttccaacctgtgtgaacaatagaatatttcccttttaatacatggaaaagaggaaaaagaggaatgatgtatgtttcgagatatttaggctggtcaaactgttccaaggcatcaccacctgctgtttttaatcattaatgaggctgtcagttgctctaatctgggaggtgaaccaaaagaattgttttgactttaatttaatttaaaaatcagcttattgaaaaaaaatgcttccagcttctatgagtcaggttgcacactgttgataaaacaaagcaagtcaaatgttgatgctgaaccatcattcatatgcaaacgtgaaccgttttaaatttgcagaactcttattattaccatcactagccagaaattttagttctttttttgtttgtttgttttaaacagcgtctccctgtgtcgcccaggctggagtgcagtggcgcgatctcagctcactgcaacctccgcctcctgggttcaagagattctcttccctcagcctcccaagtagctgggactacaggcgcctgccaccacgcccggctaatttttttttgtatttttagtagagacggggtttcgctatgttggccaggctggtcttgacctcctgacctcgtgatctgcccacctcggcctcccaaagtgctggaattacaggcgtgagccaccgcgcccggccaaattttagttcttttaattcaagtagtcattgtattctggagacatgctgcgtgtaaatatctgttccattttttagaagaaaaactgatgcaccaaaattttaaacactctattaatgtcagaacacaaatctatagcaaagtccagagtgaagcctaaagtgcaaattcttttgcttgactcaatgctcatcacactgtttgtatgttttagaagtttagtgactatctgtgagtactctattaagttggagttttcttcactggatggttttgcttagtgacaaaatgagaactcagaaatacagtgtctgtgcacaagtggattttaacgacctagagccagacctttgtttgtgccaactgtcaatttggaaggtttcattatgcctctctcagcttcatcaaacactttcagatttataattgatgtcaactgaagttgaagtcaaagaaaaccttctttttttgactgtagaaaatatcaccttattgttgggccctggttagccggagggtaggtgtatcaaatcacactagccttctgctaaaacagcaagtgagcacttgctgaattcagctgataatcaatctgcagctaatgagtctgcagacagactgagcggctggagctggcaccaggaaaccaccattccaactaaccatctcttattaaccttttggtgtttcctttgtgacgctaattagagacccataaaactatctgctctagatcttccgtttaaaatacaattttcaaagaaacacaattcactttaaggctcctgttagtatggccttttcaaacctcatgaaggaaaatgactgacttgccatttaagtaaagtttggataattaatctgtaatgttttggtaattaaaatgccaggaaaagttggttctgtagttggtataatttataatactctccagattccggtggtactgaagtaggcggcagatgtttctaccaccgttatgttttgactgtctgaaagtacccattcccacgctgtagccctgtctgccagactgcctgtctgcctcctcctttggtgtgaatttgttttgattgcctgagggggttagatgtgtgctttgcttcctttctgggggatgatgagccaaggaatgagctttgtactcttgggagagggaaaagtcttcgaagttgacatgctgtttagctcaaaatgagttatcaaatgggcccactcaacgttcaaactgttacatttgcatgatgaagatggaggagcaccatgccttcctgctctagtcccccatctcatttcctctttaatattttttacacccagaacaagagcattatgagataagtgttctaagcgtgttggacccatgtattcatcctgtgctttcgtttacctgtctacagcaccttttagtgcctcatttctctcatttgtttaaaataaaaaattacctagcataaatgacttacatgatcctaggggacagaatctctagatgaggaattgactgactattaaataagtgagatctgcaaagctggacattgttttatttgatttagcaaagaggtactcttcgagaagcccaatattaatcatctaggatcctttagagattaaaatatccataccagaaatgcaggcacagaacccaatattcttgcagcattacctggagcccctttggtatcttaagttttcattgtcatcaatatggaatgttcaaagtcctaaaaagtccctgaaatcattgtgatatggaactcatgttataatatatcatttatcccttacagcaacactgaaagggagagacaagcatagaattccaaatagtcaacagaggaatgacagccatctatagtgaggatcaaaatcagaatcttggctgatggggaaaggttcagaaaattagaatgaggtgataagagagaatgaaataagataaaaatatctatggttgaaaccgagattggcagggacaaaaggggtataatccagatttccttttatatgtactatctagctaatactcattgataaacctaagaattctaattctcattggagtcttccagacagatagtgtccaatcacttcaggctccaactaatatgagccagtcctaatgaatcagtacaactatttccactctactccattatattcaagattgacatcattagtctgcctgtaaatacaaaggcaggcagaacatcatagtggctaagagtacagactttgaaataatacagatttaagtttcatgcttatctttgccacttaatagctattgaccttatttgttcgaatcctcaattttcacaactgcaaaatgggagtaatgatagaaattacctatcagaatgttgtgagaagatccagataaatacttcctggaatatagcaagtgtccaaaacatagcaagtgttattgtggggactgagtcagtggaatagccactttataggatttcaggtaccctaccactcaaagcccctcatctgtttgcttctatctctgatccctttaacagaaaatgaggcatttcattttacagttactgttcacactttaagcagtccatggggagagaaaatgcatttatttaaattcacactaagttgtaaatagttgctattagattgtttctaagcttattatttgagaggagtggtggggggaagaggatcgtttctagaatattgaactttaaaagtctcagaggggagaatcagaggggagaaatgcatagaaatggggtgacaacctcatgagtttgccagagctattggtgtccaaagaaagtaatttgatttactcactgtgaaatgtctggatgctggaaagctgcctttactatcaaatcatttttctgaatcagcccagactttgagaaattataacatgtctgccaaaggtttgaaaagaggttgtgttcatttacattgcaaaatatacatattcttgagcacttactgtgaggtaagagaagccctggttcctctctggaggcattgactccactttgccctccctgtatcaaaagctgcataccccagccccaggatccctgctgctcttccctgctctccctctcttgcttcacggttcttaaatggctaatgggtggtagacgtcattttgattcctttattttctctcccactgcatgcccagactttcattaaaaaataaatgaggggatgcatttttcatttttagtttattttctaaaaaagccacactgcaaagaatcccttctattctttttttctaacaatggactgaaaaatgctcagctcctacctgaaaggtcatatctccttgccatatgaatgagcttccagcaggtccatagggagagtgtcatctgagaaatgatgggaatttatgtgcctttggattttggcctcattttgtagtggaaaaataaatttgttaatgatagaaaaaaaatctcaaccaaagccctttataaaattctctctctataactcccaggagggagcctctcagacacacagttgataaatgaaaaaatattttttacccttgccttgcttagagctgtttctcttatattaatgtaagccaggtggcccaccttcgctgataatatggtgttgaatatagcaacctgcagttctattgcataaagtattttggcttgtaagggaccttgtgacatgtttgtgtttgtcaacatcctattggaaagtagggcttggggagacatgtacacacatagaactgtgtggaattagggatatgaaaaaaacaacttataacacagaggcaagcactgtgtttttgaaaaaggcagattcattgtgaaaataaactttcttttatagtttgaacattccatgaacaatgtaactggaagtgcatactttttgccttccccaaaatctaaatccacgtgctatatacaaaatgctaagatcattatagtcctggccgggcgcggtggctcacgcctgtaatcccagcactttgggaggccaaggcaggtggatcacaaggtcaggagttcaagaccagcctggccaacatggtgaaaccccatctctactaaaaatacaaaaattagctgggattggtggcgcatgcctgtaatcccagctacttgggaggctgaggcaggagaattgcttgaacccaggaggtggaggttgcagtgagccgagacctcgccactgcactccagcctggcaacagagtgagactccgtctcaaaaaaaaaaaaaaaaaaagatcattatagtccctaacatactttaatgccatgacctactgggaaatgagaattgtagttttcattctattgtttgttcattgtagagccttggataagtcactaacctctcaaagtctcaattcgtatatttacaggtgggatgatgagcaatgttgcattaatgttgataagaccaataatcaaagtgtctatctgtctatctatctatctatctatctatctatctatctatctatctagtattttttcttagtacaatataattgtgaatcggatggctaggtgttttgccggtttttggtttttgtttttgtttttttgttcccttctcttccttggcctgttgacctgacctgagaattgggaactttatgtgctcatcatattccacagattcatagcctataaacaagttacttgtccagtctggtctttggatttctcatctgcagaatggaggatactggtagtacctgccttgtggggtggttgtaaggattaaatgagatgacacatgtaaaacacttagtgcagtgtctgttccacagtaggcacttaaaaagagtagcggcaagatgatgctgatgaaacattctccctgggttcctgtctcccctcttcacttatctacgtctctttctctctttaaaattacaagcaaaatttaagtcccagaaagcagcctcttttgactaatggtttgtcctgatctctcctttacttggcgttctttaatatccatgtacagagtttatatcatgttaatttgcttttttcctgttttttaaaaatgtaaaatgagagagttgataattgttaagacatttcaacttctgagcttcttttattctgattttgggttctgggtacaaccttttcagattcctgagcacacagccatttgccaatggatctgtaatgagtgccacactcaaattaacagatggtgtggtgcgcttgctttgaggggtaattactctttcatcttaatttcctccctttggcattccttctttggatactgttcaatggcaatgccacgaagcataggatgaaaatcaaacaagtagcaggtcacttgtctatctcagacaaaattattgttaaaactaagaaccagtgaaggtctaccaagtgaggggcttgtaacttctagtattagggaccaagtaactcttaagggtacttaattgtctgatcgttcctcctttcctaaacaaggtggctatttctagttgataactgtctccatttttcttaaagtttaagtagattcctcctctatggccatcatgtcacacctctcacagttggtttgttcttaaactcttaacactgtaagccaaatctgatgtcctttcatcgttggagccagttgtaaactgctaactttactatataaactcctttcccctatcttcttcctcctctctcgtcacacacactttttcccctgatgcttcttatttagttctttctccaaccctccctgctttcacctcagcctaattctatccttttcccctctaggcaatttctcattcatcactgtgtttttacagagaatagaaataatttttaatgacattgagaattttttttttgggttttagtggttcagtcttcccttgtgaagatttttatggcttatttttatttggtaaagttaccttctttactattttttctctccttccacacaattcacagtatactaccatgagtgaggaaaaccctcagtgaataagcgctgatcaatttatttctctgaacattaccaaacaacagatgccatccaccaatgtttgatccccagggcagttcttatctaccttattttacagattccagaggtgaaatgatctattgtaaagcagtgcaaggatcagaagagagtttgtgtttcctggatatattatgtgacttcagggcattgttctgctttccatttgaaatctcaaaggctattggactgacaggaagttttcattcctgttatgaaagggttactgcctccagtttggaagagatgttgcttagggaaacagcagcagattatagcagtaaagccagaaagatcagggagtcagaagtattactatgagatggaaggaaatagctggtgtgcctaactagctcaggggcatgtttgatagtacccaggtatgtctacagaactggcacctgtatagatattgacctctcagtgtgtgttttactttttactctttgagttggactgctgtgttttctgtgtcactggtaattccattgaccaaaacacttcagttgaatcacagcttgagtcttcaagtttccttccctctaaccttgctggtttcttgctcatgttgatatttaagaacgttttctttcaattcagcaaagtttccggatacaagattaatttacacaaatcagtagttcttctataccacaacagcgaccaagttgagaatcaaatcaagaactcaaccccttttacaatagctgcaaaaatatatatatatatatatatatatatatatatacttaggaatatacctaaccaaggaggcaaaacacctctacgaggaaaactacaaaacactgctgaaagatatcatagacgcaaacaaatggaaatacatcccatgctcatgaatgagtagaatcaatattgtgaaaatgaccataatgccaaaagcaatctacaaattcaatgcaatccccatcaaaatactaccatcattctttgcaggattagaaaaaacaatactaaaattcatatgaaaccaaaaaagagcctgcgtagccaaagcaagactaagcaaaaacaaaacaaaacaaaacaaaaaacaaaaaaacaaatctggaggaatcacactacctgatttcaagctatactataaggccatagtcaccaaaacatcatggtactggtataaaaataggcacatagaccaatggaacagaatagagaacccagaaataaacccaaatacttaacagccaacttatcttcaacaaagcaaacaaaaacataaagttggggaaggacacccttttcaaaaaatggtgctgggataattggctagccacatgtaggagaattaaactggatcctcatctctcaccttatacaaaaatcaactcaaaatagatcaaggtcttaaatctaagacctgaaactataaaaattctagaagataacattggaaaaaccttctagacattggcttaggcaaggatttcattaccaagaacccaaaagcaaatgcaataaaaacaaagataggccaggcgcggtggctcacacctgtaatcccagcaatttgggaggccgaggcaggtggatcatgaggtcaggagatcgagaccatcctggctgacacggtgaaaccccgtctctactaaaaatacaaaaaattagccgggtgtggtggcgggcgcctgtagtcccagctactcaggaggctgaggcaggagaatggcgtgaacccgggaggcggagcttgcagtgagccgagatcgcgccactgtactccagcctgagcgacagagcgagactctgtctcagaaaaaaaaaaaaaaaaaaaaaaaagaataggtgggacttaattaaactaaagagcttttgcactgcaaaagaaacagtcagcagagtagacaggcaactcatagagtgggagaaaatcttcacaatgtatgcagactaatatccagaatctacaacgaactcaaacaaatcaatgagaaacaaacaaacaatcccatcaaaaaatgggctaaagacatgaacagataattctcaaaagaagatatacaaatggccaacaaacatatgaaaaaatgctcaacatcactaatgatcagggaaatgcaaatgaaaaccacaatgcggtaccaccttactcctgcaagaatggccataatcaaaaagtcaaaaaacagtagatgttagcatggatgcggtgaacaggtataacttccacactgctggtggaaatgtaaactagtacaaccactatggaaaacagtgtggaaattccttaaagatctaaaggtagaactaccatttgatccagcagtcccactactgggtagctatctagaggaaaagaagtcgtcatacgaaaaagatacttgcacacacatgtttatagcagcacagttcacaattgcaaaatcgtggaaccaacccaaatgcccatcaaagaagctgtggtatatttatatgatggaatactaccagtgataaaaaggaataaattaacggcatttgcagcaacctggatgagattagagactattattctaagtgaagtaactcaggaatggaaaaccaaacatcacatgttctcactgatatgtagaagctaagctatgaggacgcaaaggtgtaagaatgatacagtggactttggggacttggggggatgggtggaaggggggcgattgataaaagactacaaatagggtgcagtatatactgcttgggtgatgggtgcaccaaaatctcacaaatcaccactaaagaacttactcatgtaaccaataccacctgtaccccaatcacttatgggaaaaaaaaaggttaaaaaaaaaaaaaagaactttttctttcaaaaaaatgctgatgaaatgcaagtttttagcttctttttttcttgtcatttccactgatctgggctgttttagataggatgttttcaaaagttttatcatatggctctattctttttggcttattggactgcaagtgtgctaaggcccagtcattcaagattgattagttctttgtggtactatatgggcattttggtgattgtcatttctcaaaaatgatccaaaaacgattttccacattgtttaaacacactgttattactcttaacatcccaatagttattgaggtgtttattattgcctttttcttttaattggggtttttattgcataggaaaggggaaaagccctgattcaagcatttggattcaggtcctggaactgccactaactctgtgtgatctcaagcaacttgcttcctcgctttgggttccagtttttttcatctgtaaatgaagagtttggattggaatgacttataggtgcttattattgctaatactctattactgtttattgtatatttaatatggaaagattgtttggaaagtggatgacattttggctggattttcctgtgtatttctaaagaccagggcaaggtgggaaatctgactcttactcctggggctttgggctgtaataatccttccgttgtggcaagaggaatgagggtgagacattggtgaagttggcttttgttcaacattctgagcttattccttcttttaggcttttgtttgcatatgtttagcttaactctgctttcaagtgtgtgtattttcgtggaaatggtcctcttttccttttacaccaaattcatgttctcatcttccttctcccttactgaatcatccatttctgaatagttagcaattttcaacttaatgaggtctttcccctaagtgaagaacacagctgttcctcctctgatactttggcagctgcctctgcctttcccaaaatggaatgattagctctttcctttgattttttagctggccattagttcaggactactagcccatttcctgtgtgatggaactaccaaatcccatggccagaattgttccaatttgcctttagtgtcttttagtcttctggggacttaattcatatgaagtggaggatttatcaatctttcagaggtccatttgcctcattatctccagtgatttcattgttcagccttttgagatgctgatctacgaggagaacctagcctggtgtccctgatgtggttttgctggagaaatagcagataagaagatcctcaatgtattttgttcctgaatcaaatagccctcatttgtcacaggatctccacttcagtttctgaaaagcccttttgcctattccattttagtcttatgtacctgtatttaagaaagtgattactgtttttcctcatgtactttgacttcatctgcccctccagcctttaattttatgatttcacatcccttgttaattgttgggatttccttttatcatatgtgtcccttacacttaagatatcaagtcaacttctccactccactccaattcccctctcacattatgctccctgttaatcaatcaaaagcattgtgggtttagtagtgctgttccaaatgtgtgtggtgcagcccgtttttgcttccccaccccaaacgcctcattcaatttaattccatatacttagcatattaggcatcttgtcaatatttcctttctgaggtctatttttaaaatttgaatgcattctgcatgtgtaggtttttttttttcttaaatgatgagatctactgcaacagagagccagaattagctctgtgcctaggagaaaaggaaagcacagagggaaagaatatttctcacattctcagaaggtgtatgcaagagccagcccttggcacaattatttatacagtgccactatatctatctgcgtgcaccttcccctccatttgggagcataggcatccagtattctccttgggttttcttagtttctgtcaccattaacccttctactcagggccctgcattcccagtctttcctcgtttcctactttccccataaaaaacttacctggtccatgttccatttccccaaaatcctaattatttcaagggacctgttaaaatgacctgttctttctttccaaatagtatttgtatctcaatgtgatgataatccaaaagaatacctaatggtggcatttgggtcaccaatgcagcctgatggcgtgatgtcttcaggatatggccttttccccagcatcagttcctttatatcccaccaatagttggctacatggtcaaatgataaggctagcttggactccatttatcccagagaattagagctgcttgatgaataataatacctacctaacatatattaaattcttccttagtgcgaggcactgtgtagctcagcttccatgcatttcctcttttagtcattccaacaattccttatgaaggtcagtgctattagtcctgacttatggaagggaaaaaaggcacacagagtaactttaagtaacttctataggatagggctgttaagtcttagatctgggactctaaggtagtctcgctccagagcccatagtcttagactctgctgcactgcctctgggaaaaggatggtacctttttcacatgtacacctcactcagaagagctaacttcagatgtgctgctgggtagtaagcttccctttggcaaggaacaaatgaagtcttgagttgctccagtagatctagcttatatctcatcctttctggagagaagtttgcctttggacacaatgctacagcagaaaggtttgcctttgcttttctgcaccccaaaacttagcagtattaaaaactttcttcaccagtccctgtagttgtaagtcatcagtagggatatttgccaaatgcttaggaccaagcttacactctatcttttctctaccttcagagctgaaggagctatgtatgtgtgtgtgggaaggaggctctctttggtgttggtgagcatgaatatgacagactcggggtagggggatacatgaaggggagagcagactcatccacactctcaaggcaagtatggttagaaaccctgcttcactcaggtagcgctagtctcttcactgtaagtaggttttttttttttttttaaatatggtgatacaatgaattgttttctgaggtggatggttgtgttttctgttattactgcttttccttctggaccgaacttttattggctgctgcttacttactagtagaatgcttcacacctgtgggctgctgcagtcatgacaatgaacattctgttcagaaggggagcattcattctctttcccagcagctgttaccccaacattgggaatttaatgcattcatttgttctttagataaataggattaaattcagaatgaagcaaggagtagtcttagtctgtgctttgcatgattttcagggtctgtacagttccagctgtgtaaacatgattgcagaacttaagtatcgtctaatgggggaggatttcaatttaggagtggcacaccatagctgggctggagccagacattcttccacccacttcagtccacaccctgcggagtcggcttgctcagctcctagagtcagaagtgaagatggggcagctgtagttaattatactgtattatagcttcttatcagtaggggatgagaactaggcaagggctaggaaaatctaaaattatatcctcaaatatgctccagttatggcagtaggaaacaaagaaatggaagacattggacaaagtagggcagccccaaatattaaatatgacaagaaaaaatccaataaaatatctattgaaattgtagctacatttatattccaattgattcttttttgtggtcactgaaagcaagagtagagaaatattgtattgattgtaaaatattgatttgttctaatatttggactcagttttgttttcttgagatttgtttaaataatgaatagctaagtaatgctaaagacttctaataaaggagcactattattatggaaggaaatgcaatttcttcataacaaatacaaatattatggatcatccaattcctttgtccttgttcctccacccacaattatgtacagtgttggccctgctcagttcaatagagtcttagatccagtaattattctgtctctctaaagaggaacatgggcatacgtattcctgagccctaaaggatgggatttctgatgatatagcaggttttgtttgatgccatagattctccaggttattcttgggggagtatcattgatagctaacacaaaggtacttggcttcctactggatatgaatgtcaagacatggtcctgatcaaggaagacaacaaagcattgccttttgaatgtgctggggattgtaatgcatttaggaataacccaatcaatgatattcgttcctattacaactggctattgaaaaactatttttctgagaagctcacttcaaaatgtctctgagacagaatattcttttataggatggggagctctggattgaaaaagagaaatgctaggctgataaatcactgagtttgaatcatatggaaagtgttcaagaacagaaagagaggaaaattcaataaattactgttgatgcaatattggatggtcagggtgataagacactcactagagatttccagtctatgatgtacacacatgcattattttgtttactagttgtggtagcctgaagaggcagaaacatgcctccagaataccagcagggcataggggaacctctccatcatccatcatattcaactgtagtcggggggtgatcctgtcaatattgcctatgtggtatctctggaacttgggactgggatgcctattagtgcttcactgaattctgtatttgtagcatgtgcattgtagcatgtacataccatagcacttagctcgtggatgcttgtctgaatcattaggtatgaacattatgggtgccataatagcacaggaattactgcaactaaaaaggaaacacatggcttgtacttcatccacaatcacttacacttaagctattgatagttgattgggatatgtgaactgctgggcttgtgccatgggacttctaagcatatttggtgggcggaacagacaggaaggctgtagattttggcaagctgtggttcccattagtcaggctaactgtatctgacagtagagatcccaattcaccaagatgaagcttacttctctaggttttggctgatggcccaacaatattgacgtgaaggacaggagaggaccaatgttacgttaggctgtgagtttctaatgagcaaatagttgaatggtttagtgaataccctgttggttttttggtggggtaaacacaaaattcataatttgagagacatgtaagactcgaaattttcttttatagtacatgttaaccattcattctcctaatagggaaatgtgggctcttttatagggtgtgcatattatgtagttgtacagttaatactcttctctgtgtttttcttgtaaggggtgctgataacataccctactaaggaaattccaggcacagctgtttctaataataggtgccccaccccacagaattgtcaggcttactctcaaggttctttggtgggaaggaggattttctggcagagtcttggccactgccattgtctcagattgcctccctgtagcttccttggaggtatgagtttctaagcagaaagatttgctgtgatgagggaaggccacaaaactgaaggaagagagatgaggtcttatagaactaagtgagaggctgttttggtcatggcagagatgagttgaacactatggaatggagacaagatgagaagaggagtgggaatcaattcatgaaagcacttattatttataagttggaataaaaggttcattgaactccaggggacccttcttatatgaaatgcttgtgaatatgttgaaattttgtaacggcaattccatcttaaatacactgggggagctgacaacctgcagttcatggattattctatctagtgtacaatcactcttctattctaccctggacattcttccaggtgtggtcaagagaaagcggatagaacagatggaatatttcctctcaggagagttcaagagcttccttaaacaaaggcaagatgtgagcataaccttttactttctaaacaactttttctgagagctacctggaaaaatttctagcttcctcacagatccaagtaatttctgaaaatatttagagactagtaatcgtttaacttctaaaaatcaaagttggtttgtgctaaaaatatcatccggacagtctgtgtctagttgagtggggaagaaaaaaaggcaagctcttggtatcaatctttattccctctgtaaacacacatgaccagaagagaaggctgttattaatggtaatgcagaccagaaaaaagggtattattttcagtctgttgaacagtacaaaaatgcttctcaagcactgtgttcagatgtttctttttattagccatcacacaaggaattagactcatttcaaacagttcgtttccctactcttgtctccgtaaaatcgttactcatgagtggtttctttgttgaaatactgctgacctcccatattggaatgcacaacagggtgttaaaaatataaactttttagtttgcataaactctggaagaagggggacaaagattccccaggagaataaaaccattcgccaatgtccttgtttattagtgtcctataagcatcttattcaggaagctatgtcagcattacaattctgtatagactttgtgtgtgtgtgtgtgtgtgtgtgtgtgtgtgtgtgtgtgtgtgtgtgtgattaacagcagagggctctttgaattccagcaggaggttttaaaatataattctgcatctgcccctctttcttgtcctttccaacccttttctacctcccttctcatcaccgacccatccagggccattaggatagataaaggagttgtgccatgtcttaatatatgagcaaatgatgatccttagctctacagctaggcgctgtttgcattttgccaaaggtgattattttatctgcagttttaatagcaaaccagattatttgctgttcactaactaataaaagcaaataaaaacagattgcaaagtggaattaaggggataagaaagtactagagccaaagaaggctttttctttaattaataatttccatttactcttagaatatttttatgctagagttcaacatcttatattaaacatgtgtgcacccttcctcttataactgccgaattggaatctcagaatggaaatcatgcaggcttgaacggagcttcaaattctcccagtgttgtcttattgtctgtacacagaactagactcctcagggcttcccccaccacagcatggcattcctccattagccccatgtttcccagacccagtcatgaagaactggcattttaaccaacaagtagaaaacacaataaaattggagttcaggagatgcaatgttttggagaaacagattattccaagagtgtaaagatacatgatctaaagatggacagaacatttaaatttaccagcctggttttcagtgattttttgatttgttcaattaatttgtgaatgaaaatgcatcttaaggatggtgaggactggtggtagtggtggtgaatgtgcgtgtgtgtgtgtgtgattttgtggccatgatccaggcttactatgcatcagctcctaaagagatttttacagagctgtgtctgagtgtcttaattcaggtcatctcaaccagagagccttctgctactcctacgtgcaaaggctcgagttaactcagaaaaagttctcacagctgtggcccagatagattccaagacttctctgaaacttcagatggaagagcctttctctttaatagagagccattctctctattaaagaagagttgggcaagctggaggccagaggattatattgtaatcttcatgtgctgaaaggtgtaaagaatcttttcttcttaataagagcactgggacaagcatagggtgccttcaaattatcagacttcctcaaacaatagatcaattagcctttcttctgaatttgtgtaattgtttttgaggcaacaccctgaaaaaatatagcttactttttccgactagtataattaagcggacaaatggaaaaagaatcattcaaagtaaattttaaagaaaagagcaaaagagtaaaatttagcattgtccatgtaagatggataatgacaagtaaacacagaaggtggtgtttgatcccttcgattttggtattcattattcatagttattattcataaattccaggttaggcttgtgccccagtgacacatttgcattttactttaagttgatttctacctggttttgcaaacaaggatttaatgatttgggctgcctctcactcttcctctgttgcttgtcttttcatatacagtgctggcttctagccccttttacaccctttgtctccatcatcagtcttgctctcccatccaatgttttactctcactctctttctctcttctctcttctctctctctctctctcaatgttttaggaaaaaagatttctaacgtggaaaactgatatttgaatagagtcccctaaggctatcaatttacttttaatttgtctggagctaagcttttctttgttgcaatgaggaaggattaaaactgctgtaaaatttattagcttccagaaagatatttgaaatgcatttttttaatgattgtgctgtttgctgtacccagaagcagtgtcatcacaactatagtattccagatggttcccgaagttacactgaaacatcaagataatgctagacttttttatgacgcctctattggtaatgaatagtccatcccaggtagctaatatatattaattaatatatatttgtttccaatgaccatttctagtgatacccagctgatgacaaaacacacacactatccctttgaatcattacaggagacagtgattggtttactgagctctttattttccaaatgtggaagaaatgattggagatttactaatgctgtttcttagcttccccacccagtcctaggaacatattggtagtcaagaacctttaaggaatttagaagttacagttgcaacatttttcatggactcatgtatagtatggcctattctacaaaactgaatgtcctgggacttgactgaaggaagtgtcagttcctgttaaggggaacaccagctgctgggtgccctttttgttccattcaacagtaagttttcattagaaaagggaagatttttctcttggccaacgtgctctgtctactcttgctttctgtgtcagtcttatgtgtgccatcttcactatgtattctcctagaagctcatgaccatcatgaaagtggcttcttcacaagctgatgatctgctagcagtttccttattttccacaaaagagtgaaaccaagttggagataagtttaggttcagaactattttttaagtgtgataggctctgtgactgggcgcggtagctctctcctgtaaaccctgctactcctgaggctgaagtgggaggatcctttgagtccaggattttgagaccagcctgagcaacatagtgagattctgcctctaatttttttttttttttaattagccaggcacctgcctgcagtcccagctacttggaagaccgagccaggagaattcttggagtccaggagttggaagctgcaatgagctatgattgcactattgcactccagcttgggcaagagtgagatcttgtctctaaagaagtttttttttaatttttttattatttatttatcatttttttgtaaaggctctgtcatcctagatgtataactgcatgtagaatgcatctgacttttaaatctacaccaagtcaaataactgatttgaactcttcagagaagtgacaagatgttgtaggtatcccactaatataggtttgagggacttaattctgtgggcgtctttatatgaaactttcaaaaacggtcctatgtttttcagagttgtagtatctcagtgttctatcttttggggaatagctcattggccttctgtgtcacctcatatttactagtaaagttgctttttcaaatggtttataagcacctagatgaagtccagcactttgtcagattattttctccatcacagaagccaaaatacaaagatttcagtctagtcaatctctgcttatctcagtcactgtcagcacctcttatttcttagtctcaattttccaggcagccttttgcttgatttccttgctccccatgcatcagcacaaatgatttatacttatgtacatcttgaaatctcttctttatggattgaattgaatcgagccccagtacaaaaatgaaaactccaggaactgttgtgattgcccaaattacaacttggattgtatgactgtacacgccacactctcatctatcataaatattaaattctcaagcacttatacttcaatatgttttaactttgtctgtttgaccagctcagcactaaagattccattgaagataattcaattgctttgaattctgaaaggggcatctttttaatctattttcatgttgcactgggagttaagtgaatttcaggtgcatagcctgtgaatgatgggagaggcctatgtgccatttggcatcacagaggccaaatattgggtgacatttgctaactaatgctgatcagtgaaatggtctaggacaagattggggttcatcagtcttttcagccattctccctatctcaaactaaaactaaactttgcagaatttctgctgttttgtcagccatactgaaaatgccaagttatgctaaccagggctggccttttttcttctgtcttgtcttttggcaacatccctttgccagtctcaggaactttgttcccacaccccatccccatccttcatccttcctgaggcatctccacatccagacatttctagtgtttttaaccccatcaaatctctcttatcctggatacccttattcagggctctgttatgtgacccaaaaaaatctgataatctcagttcgataatggtgcctcttctaaacatttttttaaatttattttttattttaatagtttttgtggaacaaatggtgtttggttccatgaataagttctttagtggtgatttctgagattttggtgcacccatcacccaagatgtgtacactctacccaatgtgcagtcttttatctctcacactcctcccaccctttcccctgagtctccaaagtccattgtattattcttatgcctttgcatcctcatagcttagctcccacttattagcgagaacacataatgtttggttttccattcctgagttgcttcacttaaaataatagtctccaattctatccaggttgctgcatatgccattattttgttcctttttatggctgagtactatttccatggtgtgtgtgtgtgtgtgtgtgtgtgtgcatgcatcacattttctgtatcctctcattgattgatgggcatttgggctggttccatatttttgcaattgcaaattgtgctgctataaacatgagtatacaagtgccttttccatataaggacttcttttagatacctagtagtgggattgctggatcaaatagatacacttttagttatttaaggaatgtccacactgttttccatagtggttgtactagtttacatactcaccaacagtgtaaaagtattcccttttcaccacatccatgccaacatttattatttttttattatggccattcttgcaggagtaaggtggtatgacattgtggttttgatttgcatttccctgataattagtgatgttgagcattttttcatatgcttgttggccatttgtacatcttcttttgagaattgtctattcatgtccttagcccactttttgatgggattgttggttttcttcttgctgatttgtctgagttccttgtagattctggatattagtcctttgtcaaatgtatagattgtgaagattttctccctctctgtgggttgtctgtttattctgctgattatttcttttgctgtgcagaagctttaattaagtcccatctatttatgtttgtttttgctgtgtttgcttttgggttcttggtcatgaagtctttgcctaagccaatgtctgtaagagtttttccgatgttacctttagaatttttatggtttcaggtcttagaattaagtccttgatgcaccttgagttgatttttgtataagatgagagatgaagatccagtttcattcttctaagtgtgacttgtcaatgatcccagcaccatttgttgaatagagtgtctttcccccactttgtttttgtttgctttgttgaagatcagttggctgtatttacctttattcctgggttctctattctgttccattggcctacgtacttatttttataccagtatcatgctgttttggtgactatgcccttatagtatagttctagtcgggtaatctgaagtttccagatttgttcttttgtttagtcttgtttttgctatgtgggctcttttttggttccatatgaattttaggattgttttttctagttctgtgaagaataatggtggtgttttgatgggaattgcattgaacttgtagattgcttttggctgtatggtcgttttcacaatattgattctacccctccatgagcatgggatatggttccattggtttgtgtcatctataatttttttcagcagtgttttatagttttctttgtaggggttctttcacctctttgcttaagtatattccttattattattattttgcatctgttgtaaaagaggttgagttcttgttgattctcagtgtggttgctgttggtgtatagctgtgctactgatttgtgtacatttgattttgtatcctgaaactttgctgaattcatttaccagatctaggagctttttggatgactcgttagggttttctagatatacgatcatatcatcagcaaacagtgacagtttgacttcctctttaccaatttagatgccctttatttctttctcttgttggattgctttggctaggaattccagtaatttgttgaatagaagtggtgaaagtgggcatccttgttttgtttcagttctcagggggaatgctttcaacttttcgccattcagtataatgttggctgtgggtttgacatagacagctcttgttaccttgaggtatgtcccttctgtgctgattttgctgagggttttaatcataaagggatactggattttgtcaaatgctttgtctgaatccattgagatgatcatgtgatttttgttttaaattttgtgtgatgtgtcacatttattgacttgcatatgttaaaccatccctgcatgcctggtatgaaacccacttgatcatggtggatgatctttttgatatgctgttggattcggtcggctagtattttgttgaggatttctgtatctgtgttcatcagggatattggtctgtagctttctttttttgttatgtccttccctggttttggtattaggatgacactggcttcatagaatgatttagggaggattccctctttctctgttctgtggaatagtgttaataggattggtaccaattcttctttgaatatctgatgaaattcagctatgaatctgtctgactcttgttgacaattgttttattaccatttcaatctcactgctcattattggtctgttacgagtttctatatcttcctggtttaatctaggggagttgtatatttccaggaatttatccatttcctctaggttttctagtttatgcacataaaggtgttcatagtagccttgaataatcttctgtttctctgtggtatcagtagtaatatatcccgttttgtttctgattgagcttatttggatcttctctcttcttttcttggttaatcttggttaatcatttttattcatttttttcaaagaaccaggtttttgtttcatttatcttttgtattatttcttttgtttcaatttcatttagttctgctctgatcttggttatttcttttcttgtgctgggtttgcatttggattgttcttgtttctccagtttaatgaggtgtgaccttagattgtctatttttgccttttcagactttttaatgtaggcatttaatgctatgaactttcctcttagcaccgcttttgctgtatcccagaggtttggataggttgtgtcactattatcattcagttcaaagaatttttcagtttccatcttggtttcattgttgacccaatgataattcagaagcaggttatttaacttccatgtatttgcatggttttgaaggctccttttagagttgatttccagtttttccactgtggtctgagagtacttgatatcatttcgattttcttaaatttactgagacttgttttgtggcctatcatatggtctgtcttggagaatgttccatgtgctggtgaatagaatgtatgttctgcagttgttgggtataatgttctgtaaatacctgttaagtccatttgctgtaggttatagtttaagtccattgtttctttgttggctttctgtcttgatgacctgtctagtgctgtcagtggactattaaagtcccccactattattgtgttgccatctatcttatttcttaggtctagtagtaattattttataaatttgggagctccagcattaagtgcatatatatttaggattgtgatattttcctattggactagtccttttatcgttatgtaatgtccttttttgtctttttaaactgctgttgctttaaaatttgtctgatgtaagaatagctattcctgctcgcttttggtgtccatttgcatggaatatctttttctaacccctttaccttaagtttatgtgagttcctatgtgttagttgagtctcctgaagacagcagaaacgtggttggtgaactcttattcattctgccattctgtatcttttaagtggagcatttaggccatttacattcaacattagtattgagatgtgaggtgctattctattcactgtgcaaattattgcctgaatacctttttttcattgtgttactgttgtatagttcctgtgagatttatgctttaaggaggttctattttcatgtatttcaaggacttgtttcaagatttagagctctttttagcagttcatatagtgctgtcttggtagtggcgaattctgtcagcatttgtctggaaaagactgtatctttccttcatttattaagcttagtttcactggatacaaaattcttggctgataattgtttcatttaaggaggctaaaaataggaccccaatcccttctagcttgtagggtttctgctgagaaatctgctattattctgataggttttcctttgtaggttacttgatgcttttgactgacagctcttaagattcttttcttcgtcttgatttcagataacctgatgactatgtgcctaggtgatgatctttttgcaatgaatttcccaggtgttctttgagctccttgtatttggatgtctagatctctagcaaggctggggaagttttcctcgattattccctcagatgtgttttccaaccttttagatttctcttcttccttgggaacacccattattctttggtttggatgcttaacatagtcccaaacttcttggaggttttgttcattttttaaaattctttttctttttctttgacagattgggttaattcaaaaatccttgtctttgagctctgaagttctttcttcttttgttcaattctattgctgagactttccagtgcattttgcatttctctaagtgtgtccttgatttccagaagttgtgattgttttttgtttatgctatctatttccctgaagacttttcctttcatatcttgtgtcatggttttgatttctttaagttggacttcacctttttctggagccgctttgattagcttagtaattgaccttctgaattttttttctggcaattcagaaatttctccttggtttggatccattgctagtgagctagtgtaatcttttgggggtgttaaagaaccttgttttgttatattaccagaatactttttctgcttccttctcatttgtgtagactgtgtcagagagaagatctaggactcaagggctgctgttcatattcttttgtcccatggggtgctcccttgatgtggtgttcttccccttcccctggggatggggattcctgagagccgaactgcagtgattgttatttctcttctgggtgtagccacccagtggagctactgggctatgggctggtactggggagtgtctgcaaagagtcctgtgacatgatctgtcttcaggtctttcagccgtggatatcggcacctgctccagtggagttagcaggagagtgaagtggactctgtgagggtccttggctgtatttttgtttagtgcactggctttgtgttggttggcctccagccaggaggtggtgctttcaagagtgtatcagctgcagtactatagggtggatgctggatcatcttattttaacaggcattttttaatgcatgtatccagatgaatgaaaaatgtggaaatttttctccatgctgcaagggctggttcttggatagcacttctttggcatctgtcaggtaacaccacataggtgttttgaatgccaatcagtgctggcatcctttcccttctgcctgatgtctgtctgtcattccatagtgttgtaggggagggctgctaacaaggacgaggctagggaacgggagaacaaaaagaaagttttagggagcaaccaaaagtggagaaaattgctgaaaaaaagggaagaagggagtgagaaagagacaagtagttgtttgtagtgtaatttgtgatgtgcttcttgtcacatagagtgactacaggatagcttggtatcattggttcatgagtgtctacagatatctcagccttcactggtgttcccttgaatgttttacggatggaattccatcttttttttgctaaaattttactttagaatacgactgtaaaccccctgcaacattacagcctgggagggctctaggaagttgtcattacgctcatattgaatttttgctagatacataacagatattttccatatgatatctaaacacccaaataagcccaatcctcaagatatcaaacatatcaaaaccaaaataaaatgcctaaagccttggtaatattttccttccttccttccttccttttttccttccttcctttcttccttccttccttcttccatttccttcctttcttttccattgatcccgttgctgctttacttgccttgttaagttacagagatgggattgataatagtgcaggagagagcactattaactattgttagtatagaaaacttgcaggtctatggcaaatgtattttcaacgggatgttagagggtactagatctctctaacacctgtatatagtgtgcaggaaaccacacagaggctaagaggacacttaatgtttctcaagttctaaatttactttacgcctctgacaaagctacatagtttactttgtaggtttctgtagtatttatgataaaatagttatttccactttaggagttgcacagtatctggggtgggacagtatctggggcgttgaccaatattcttccttctttctgtgcatttttcattcaattaaattaaactattattaacagtttaattgacagctctgtgctggacgctttgctaggttgagatagatgtaatctttgctcatccagagcttaaaaggtagcagaaaatatagacatgaaacaagtacagttgtctcttggcatccatggaggattggttccaggactcctgagaatacgaaaatctgtacatgctcaagtcctgcagtttgccctggggaatctggtggaacctgtggataaatgaaaaggtgaccctacaaatctgagggttttgcatcccacagatgttgtattttctattcacattttgtggcagatgcagaacctgcagatacagagggctgaccatatttatttttaaaaacctacatgtaagtggacccatgcagtttcaaacccatgttgttcaagggtcaatggtaattacgcgtgtgatgaatgttataaaagggaagtgctgtgagatctaccttagtctaaaggatcacagaaggactccctggggaagtgaaatttaaatggagacttcagggataatgtattaatcatgaattgtgtttaaccgctagtaataaagatgcccctctcctactaaagaaaataaatcaatgacttaaataagagatatttatttttcttcttattaaagaagttcaagtttggtgagggtagctctacagtatctttaataacccaaggtccttatatctttctattctgccacccacaggcacatggcttctatcttcagggttgcctcatggtagtcagacagatgttgcagcatcagtcattatgtctccattccagacaggacaaagcaggaaggaataaagacaaaatagtctcttacctaagtcagctctccccttttaaggaattttcttaacatcttgctttataatgttggtccaatcttatgttacatgtctgcaagggagcctgtgaaatgtagtttcttttagctgagcacactgccattcctaacagaaatggggctttgtttctatttaacaaaaacagataaagatatttggcaggcaattagttatctctgcttcatagagtaggagttagataggtcaagggtgggtggtgtacttctcaacaattaggtttcctcgattaggcacatgtgaccaattttaacagcactaaacttcttcataatcattgtcataatctcctccattatatctcacaaaaaatggccctgctttggttacagattgtcttgttcatgaggtgatgcagaataaactaagtagatgtataagagtacaattcaggaagcttgtctgatatacacatcacttgcttgttggttctactactgctgccacttagaagtagccaactacttgagctctcaggaactggaactcactttaacttttttctttctgattcattgattgcagattatttctgaagaggaaacatattgctcttgtaactgtaaccttgaactattttagtgctggattttcgtctgtgatcattaggatctttgagttaatacacccaaactctgaatcacagtaaagaactgccagcattatcaaacacatccattgtgactggatatctatacaaacccagcagagcctcttagctcttctattccaccaggacttggaaagttttagcaaagcctgaaatgatgttttcatcattttcttttattactttggtggggaccatgggtaggctctttctagtgtggaagtacattgtttggccacatctgaggagatggcagtttcatgtcctgaggagagtagtaattgctgcataaagttttgctattatctgcacaaaatagcatattctggtctttttctgtttgaattacttccttaatctatcatgacttagtcattactgccttactgcctcttttgcctcttgtaccctcgcaagactgatgctttaattttttttttttttttggccaggggttttggaattctctcaccaagtttcctgatgacaaattgtgaccaccaaatacttactgctatgtagattgaagaaactttcacttttttctgtattttttatggtctaaaataatcagatttgttttgaactaaggagttctctggtctcaagatttgtgttcctcttccaaatttatgcactctgttcttgtttcttttgcaaatcctagggacaacttcagaagcagggaaaaccaatttacaaattcatcagtcaaccctcatcatgagtatgtttaaattaaagacacctgccttcattcatctatacgtgaatttccacaactatatgtggattttagaatgccacattttgctttgcctaggttcaggtcagaactttcagataaaaatgtagcaaagtatcaggtcacagataggttcataagaagaatctcagcaggaacttagtgaatcgtgagcccatctctctatataagctggagccagcaccttgacagtttgtgatgctacaaaatggttcttctctagtctcatagctccattcccagccactatactacatgaggactggcacataatctttacaagtcctatacaattacagaagtagtctttttaatttttatttttttacatctggtctgtcttcattgctatttttaaggggctttgtattgtgactttctcacatttactacacaatttctttactaaactgaaattttgatttttgaaaggtaattcatctgcagtatatttatgaatgtaaattaccctgtgctgggcagagatgttcttcctgcctgtctatattgacaatttttatttcatatataaagtggctataaacatatttaagctaagttagacttcattgtaactgtatagacaaaaatgtcacaaaatatctgaaacacaaaaataagaaacagtaactcagtgcccttggtaaggacttaaaaaaaatataggtatcagatccaagccaaggatgagacactgtgagtaaaagagtctcttagattcaagtcttcacttgcgtgaggaagggcagtgcatataataagtttacataagtaatctgagaaaactgcatatgattccagctcatatggagctgaggtaggctcagtgagcttggtggggaggcttagactgattgcattgttgggtgtgtcctgagttagtctccgtttctcttttcccaacagtgattgtttcatttagacagtgggtcagctgaaggcaagtactatctatacagagaaacctcagagaagattgaattccctgctctggtcttccaagatttataagatcttggaggtgtctgtctctgggctctctattctccctccccagatattctggggatccaagtctcctcatgctgttcatttgaggcagcctagtatagggaaggagcattgtacttggattcagggtgacacatgggtggtattctcctattgaatgctgttgaaaaaaactaaatctcaaaattagaggacagtcacttcatattaaaaaactcaaagaaataagagcttcgtgttgaagacattgggcagatggtactcaattgtacttcactactgctctgctctagaagtgtgagcaagtggcctgaaatatcagtcttaatcttggctgggattttcttttcttagttggtcatatgtccatggtttcagggctcaagggttaggtctttatgcttttatgcctttcaggtagggacaaaaagggcagagatcttatagccttctggacatttttttgctggcttccagggatttttactctgatttgtagaaatggaaataatttattgaacttttcccccacctgcaactgcttactctctctaccctgaaacactctcactaattttttagaggtattatttggaaagttaccagataggccttggaagagatgaagaggcaaaaacagcttattgggaagccctaaagatgtgacttctgttctactgaagggatcttgggacctcctgtggaaagcactatatttggaggaaactgattaaaagtagatcaactaactcttccactcatactgtttagtctacacaaagtgcttctcaagtatatcccaaaatgcttcccttactttcatattttctgcctcccaggtacatgcatgttgaatgataacagggtatcagatggcaacacagagagtttgcagggaaggggcggagaaagggccttgacagacctttcattttgcagaagtggccatgcagcctgatgtggaactgagctggagtttgcagaaacattgtcctaactaggtggaaggcactttccctgttcatgatgttgttcatttgttatttggttccactgtacaaaattctgagtgtttcattgcccagcactgaaagggggatgaaagtgtccatcttaaagataaattggcaaattatgtcaaggtacactgaagaggtcttgtctttagtttgcttttaagtagcttaaatgaggtcaagggccatgcccagaattgtgttgaaatctggatttagcttggattaggtccttgatatttaacaggcttctaatgtctttcctccaaataatgaagtgtacagccaattcaaccattattccttgagccctctgccttgtgccccttcaccaaagaacctttgatgaatgaggcatagcagtaccttgctttgctatgccatttactctttaaaaacaatgaagaagcaaacaaaaaacaccaaaaatatagaaatacaagtatacaaggaagatgtgttatatatagactgatgccaagtaagactctgaattgcagacatcttccccctgcaaaataagtcacaacataaatatatatattttatatacatatgtatatataagatatatatatgtattttctgtaaatgttaagctgctcatattttgatgcattgcgcaatgttttcattaggtcatcctcttgtaagaatgtaacataaatataaatagatctggaaaactagggctataaaacaaacattgagattaacagttttccagtaacaggcagaagttaaccctgggtccatgccttggtaaagcctgtgcagtaagcctctctgagagccagattgaagctttaacccttagtgaacctgacctggaaagataaatctatgtctgcccaataattatgaattgtaactgctgagatcttccaggatggagttaaaataatccatgaaagatttctttaagaaatatttctctaacaaaactgcagataagaaagataaggagggatggctagttgggtctaattaacaatgaccaacatgtcactgatgtttgcgtagggccaattgaagcttatgggtcagctggatagaagggctctcagtttattccttctgatgggaaatcaagtcatggaagtggcatagtgaggagattggctggtgggactggtggtcaaaaagaaggggtgtgattgggctttcacagagagtaggatatcaatctaaaattaaattaagcactgtgtatcagtgatgggtagggtggaagggtgtttggcagtgctgttgttcaaaaatatggccaaggcttcttaaatacactgactgttggattcccttccctgcctccactccctcatctgctgaatccagtttcaaacacaggtgatttttagcaggagttgttgattaaaatgctgactctcagcaccttgacactccagatgaactttagaatatatatgtattttcatcataacgtgtttccctttaggttttttgttttgtcagtagtgggaaccttaaaaaggatatacatagagggagatcttcagccttttaaaaaaatccagttcttcacacttgtcccaaaaggcaataaaggactacctaaaagtgccatttcccacaagggcctgtggatatctaagaaaccagaacactggggagtaacagtgaatcctgggaaaagctgatgaaattgatattttcttttttccaaacagatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagt

SEQ ID NO: 4772 - DNA, 118627 bp, human
agtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcaggtaaagccaagttttctttctttgtcttggatgaataaggtgtgtttatctgtgtctctgtgtgaaaatcctggtgcttttgtttcctacttaaatgcatgcagcatacttgcagtgcttctttttgtagggtgaaaagtttgtgacagtccaagttgatcaattcttttgatctgacaatttgctggaagacaatcatttagtgtttgaatggattctgtcacataatgatggtgagcagaaacgcaattatcattttaaaatttgcatagctgtctccatgaagttatggtaggaaaaacagagagagagagagggagggggagagagagagagatcatatttttaggaaaaccaccaactaccacaacttggtgtctggggcacagtgtttttgggacaggtactgaatgaaaggagagggagtgttggcagctaccctgtcttgttgcagtgatgaactctggagagagactgggagtgggagtgtaagatgggaaagggagatgagggggaggagagaacaggagtgtgtggagatgcaggtgattagtggtttttagtttattcttggcttgttttttatctagtccccaaacatctggctatataaagtgaaattctatcaggcatctgtatgttttcaaatatctggttggttggtagtgtggagaccaaacatcccaatgaggaacaagactttgcatccagatgtttcagtaaaaatagcaatcttctagagttgatgatgctttcctctaatgtgagactgtgttgtggcattaagatctggttcctaccagtggatgtcactgtgggctattgtgttacagtttctcttgaagtgtgtgaaggatgtgtgtgtgtctgtgtgtgtatgggggggggagggagagagagagggatagaagggggaggaaaagggagaaaagaagaaacacagtattttttaaaaagatttcctgataagcacattagaaggtcttactgaagccctttcttacatttggatagagcacataagtctaagcatttctagaatcctagaatccaatttaggataatacatgacattttttttccagcagtgtctcatcgaaacagttgaaaaaagttgtttctttagtttgctgaaaatgaatgatgctgctatttacaaccaaggtgtgtgtgtgctttcaacacacctacacatcagtgtgtcttttgtgccatttgtgtctgcatgttaatcagtcaaaatatgttcctgtaggttcagtttgtatttgacaccgtctgaaatgcacacttctgtgaatcagagccccctgaatatgtaacagccatgcaattattgtttcccttttactattctctgcgttacacaagttagtagacaaatgctaaccacacatgaatatcaatcaggtgccataaaagagcagctgcaatgcctcataaatgctttaatcctgttactagtgaaatggccatgacttttctttccttcagcaccaagtcatttcagatgggagaaatgtaaattaatattgctcttagctttcaaacctgtgactgctagtggcgatttttataggagaaaaatgtggggtcaataaaattttatttatatggagataattatggagaggactctttttaagccatcttctcagcataaagtaaatgcataagatcctttccttgatgaaaaagaaatcagcttgaaataaagatattgaaggctttgccacctcttggtgatgtatgactagaagtgagagccctttctgagaacttgccaaggagatgattaaacaggaggagagcatctgaatattgaaaaaaaaaaaaaagagtaaatctcagtgctctccaacttcacccaaatgtgtattttgtgaagcgttctgtttcctgtgatggtttgggattaatgaagtacagtataattaaataattggttaatacagaaagggctgcacaatgaatgcttcagctgaataatttgatggggcattgccaaagttactcatcttgggtaaacaaaatgattaaaatttcccattgattctgtaaacagattagaatagaaaatcaaccttagtactagggttttggggattttatctgctcccaaaccccagtagtaccagtttgccatcactgcaaatcttcctgagcacagagcgaaggggtgaggggaactcaattgcttaactctaggtagatcctggggacagagcaagaatttgcctctgtagatgtgtagtctccctatctgctcagactttttagaaacctaaagttcaggagcgtgtctttccatgtgattaggcagaggtttctttttctaagcctccgcagaacctcttcctgaaatgcattcatttatgagacttgcgagatgatctgcaattgctgcttgaattgggctccctttttgtattcagacaattagctttgtcgagtgagaataaggcacagtctttcccttgtaaagatcaacctgtattacttattaaccctattgttttgctgattattgcccagaaatcgaatttccaaaaaagaaactgaatcattatgtgcaaagtaataaatgactttgagaatctggctacatttaaatgtatttcttttgacaagtctcttaatgcctggtgtctttggtgcacgttgctgggtctgtgtcagtgttaattaaattgagctctttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagaggtaaaaaggcatttcccctcatttaaatgggtttggctattagatttttctaggagaggagggggtcggggggtgagtaaaagggaaccgggctagggcagggaggagggtgtggaggagacgcgaaagaatggggtctgatctcctaccccagtccaaaactgatcgagtgagtcatagaggaagctgattgagggcgtgtgccacatggcaaatgcctggaggaactggcaagggggtgggggcgggtattttttattttcctctatctcctctttggtgacttgctttgtatttcacctaggagttccttttggttccagggaagctccagatttgagcattttcatgctttctctcccataggctcaactttccctgtccccccacccgtgctcacaggccactcacaatgaaaaattccaaatccaaagtatagaaacttttttagggggggttggtgggaggttactatgtttaatatgaaaagtttatggccctcagcctgttttcccttgtaaaaagcacagggagaaacccgatgatgtaatgcaccagaataaggagctggagcggagatggggtgcaaccctctggggtgcttaatgtttattaatcagtgcatgatttgggagggtgttagtgattcatgctgccttttctgtcacatagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgaggtgagtgcagctaagtggctctgtgaggttctcccaggtctccttctttagctgctcgctggataccataagctgctgtgctggcacatcccctggcaggggtggggagaatttctctgcttatgcccattttcatactaagggtttgctatcagtgcttcttggagcaaaaggtaacccaacatactgggcctttgtgtaggtatgggtattggaattggtaactcaaagagtctgagcccttgaaatcattatcctggcataactcaagtttgctccacctgttgcaaatatagcatgcttgacagccagcagtaccagtatgccagtaaagtggcttagaaagagtcatcaagtagtgttgaaaatggatgaaaccctctaatgccctgggaccaattttccagtgtgagagtgattcagcctcctaaagaccccatttgctttttctttcgtcacatcactgttctctagcattttggtgagagaatatggataggctggttaaagggaggcaaagcaaaaaaattaaaaagccactttgccatttcttagcagttctagtggtaacatttgatggttgaggagattgaaactgtcattattgctgaaaatttaagaattagttggctggttgcagtggctcacacctgtaatcccagtactttgagaggccgaggcaggagaatcggttgagcctggaattccagaccagcttgccagcctgggcaatatagtgagacttcgtctctaacaacgaaaaaaaaaaagagtaagaataagaataagaattatctatgcatttgagtgagctctgtttctttctcttcactgggaatgaatgtatttaagtagaattttttttttttttttgagatggagtttctcttgttgtccaggctagagtgcaatggcacaatgttggctcaccgcaacctccacctcccggcttcaagcaattctcctgctccagcctccagagtagctgggattacaggcatgcaccaccacgcccagctaattttgtatttttagtagagacggggtttcaccatgttggtcaggctggtctcaaactcctgactgcaggtgatcctcccacctcagcctcccaaagtgctgggattacaggcatgagccactgcaccgggcttaagtagaaatattttttaaaatgtgatgtggtcagatgtttgctggctattgaaatattttagggcagtagagtggtatatggatgatggctggtgggtggctgggaggaaggctataagtaacatttcttaagttgatttcatttttccatgaattgcttaagtccctctttggttagaaatctgatgcactgggaggcatatgtcctcttccaagctaccagcgaaaagaatactgcatacttagagagcactttcacatctttcaaagcaccttcccaaacattgtttcgtttgatcctcacaatcaggtatcttgataggttgcccttcagtagatgatgaaacagaggtccagagatgctaagggacttactcagactcacaaagctggtcatcaagagagggaggacgagactgaaggactctatactgcctggcaaatgtgatttcagtgacaccttcctgccttaaaagtaattcagcctgacatacccaggctatgatgcatacataaaatggcctcatagtatttgtgtcaattttgtaggataaggggtcttaggaccacttacattgattgcttcttctagttcctgaacaataattcccatcagaattaatggggccaaacagcagtgcttttgatgagtaactgatggtattctgccagcaacaaaagcaccaatattttcaatttataactctataaataaggattttttgaaagtccagtattgtgctaggtaaactcagttataattattaatgtcagtgaatactactaaggcctaggccgtagactacttacaagactacttgtggatcaccaatagctcagcaatagaaagtgagaggtagtggtgtgtagtggaatcagattgatcatgattttgaatccaggaatcactgcttgctgtggaacataagactctgtttctttatctacaaaatgggcacacctgtcatgcaaagttgttccaaggaatatgacttgtgtagtgtagtaggttcaactcattggtgtccccaaaatagtagacctcttcactatacagttggagaatcagtgttacaatggcttgcactactgattgtgtctccctaggcacttgtaaccaaagaggaatttaggctgcttctatatagatacatcctacaaagtattatggccatactactcatattgatcatttaaacaatagaggtgaaagatgccaaagttgtggggttcagttgttcacaagtaacggcactgttacttgtggagatggacaaaagggttgaatcctgaggacttggtgatcacttaggcaatcaattcaaggcactagagaaatgtgagttctggtgtctatgaaatagatggagaggacagaaaacatatgacgacatctgattggtttacctaagacttagtatcatttctgggattcttccatgggctgaatgaaacaaaatattgcttcaattatttagaaaagccgtttaaaatctcagttctgatcctgtctctgactcacaaagccagatgcttttccttggttaacaaaattacacagttttggtgtgtacagctggtcatggccaagacagtgtgtactagacatagtgaggttgtgtgtatttctaatattcagtccctcctggagagttcaactggcaaacccattcagaaaggagagaggcccacttacagctgaatacagaccaggccatttaacctgaatcagtcacaatgccctgcgtagggaaaatgacacttcttttcttttataccaaaggccactggactcggtggaatacttaggtccaatgaaatctatagaagagcagggatgattgatttgttcattcaactgatatttgttgagcctactctttgtaaggcactgctctaggctctggcgttagagagatgaaaaagacaagaaatgcacattctaaagtgtgagacaatcaagtaaataggtgatttgcaatatagagtaataaatgctaatatagggtgcaatgggacattctccattgctaggataataacattttgatatatttcctacattatctttatattttcctaattaattaattaatccattcaagaaagcaacatttattaagcaattatagcatagaatgataagtgctatgatgtggcaaatataagattctatagaaatttctctatattatgttacttacattgttctttatattatttcattaaaccattctttcatttgttcattaatttatcccattagcagttattatacatttagaatgtgccagataatgtactacttcccggggatcaaaaataataaaacacttgtttcttgaacccagggagcttacagaaatacagacaagtaaacaggtaatttcaattcagaataacatcctattcctgagcacgttacattcttactctccaggttgggacaaaagggtactacatagtaggttcctctgttgggttacctgtgtcaaacccagtccctttatgagctgtagatccagttacagggcttactctcaaagggattatagacgagtccactcagacctgttgcgtgctagctgtactcactctatcacactttgaaatttatcaccatggcattagatcaagtcagcaagcattgttggagtatccactatgtgctcagctgtgtggcagggaccatggagattccaaataagtttaagacgtaacttctgccctcagagagttcacagtctagttggggagctaagatcacccacaatgatttcacgggcaagcaatacaagatagtttctgatcacctgtcgctttgtagactcctaagaactcctttctcctcctttaatggcagccttacattttatgtagatttgccattgaaccctcaaaatttagtgctgaatggaagatagctcttgtatcagtgtccaaacctagccacatctgaacattgttggctctagaagctaacagaaatatgactttgaatgcagttaggtaggcaaggtaaagggaatggaacactaatcaagaattggaactcagtttacagtattgcagagataatcttgtgtagaattgtatatcattatttacttgtcctctgatgttggctgggaaatcagctatgtggattttgtggtttcgtacacaaatttgaggggcaaagtggaggatgcctttgctgtttacagaagacttttgtagaattattgatgtcaggtatcttttacatattttaaactgaaaggtgaggtttgcattccttggtatcctggtttattttactcatagacttagtgtatatgtgaatgaattagagggcgtgtgtatgtgtgtgtgtatgtgtgtgtgtgtgtgtatgagggcgtagaaaagagtgaagagagaggaaaggaggttgaaaaagaaggaaaatggagaagaaagatagtaggtttgtcagtttgctaagatctttctaaaaatagtccaaattttttgagaggctccttagtaaggcaaatgatttttcttccggtcttatggaatggagacatgcctactggtgtctctggatgctggaaagtgttattcctttgtacagcagcattgctgcattaccatttttgtcacctggctgcagtcattattggaggaagaaaatgcaactcattgcttctactggaaatggagacttgggtgaggcttcttcttgcctccaggaggggtgaaatggcccaaacacccagtgtctttgtgcagtatttttaaattttagttttctgatgttgaatgtttctgagctgacagctgtaagggagtgatagtaggcaaaaacttagagaattccagtcataggtccgtagggatttaaattttggtttcagtctcaatcttgaattctattttctacctttcatcagcaaactgtagtttctttgatatgaggcatctaaggggtgtgtgtgcatgctctgctatagccactcatgcaacagtcttcataagtagtgacgtagccgtggaagagcttgcagaacaagaatgtgtgtggcagccaaattgaatgcttccaattatcctacaaaaagtctgaatgcatggtcatcttagtggaaataatgaaaataaaacatcagttaggctttgaaaaaaaatagcccagtacactttagttcctaaaacagagttttaaagttagagatttgcagtgacttgaatgaaattctgggctaaattagacagccacaaacctatcaggtagtagattcagaaggcactaaaaaataataggtatgataaggctggtttggatagcatggaaatgacacaaagcatcacctctaattaaaagaaaccaacaaaccctttagtgcgcgtcttgtttgtttgtctccttattacagtagggtcttggaatcatttaagtcctatccctaagggtcaaaagtaaccctgaaggagaaagcaatgagaaacaatgcagcccacatcttttcgagcattctcatttcagttttcttcaaaaatcaagggctcaatttctaccagcagtcattctagggccacccattgcctacattgtatcttattggcatgtttcacctctagctgagacagccggtttcccagtggggatgggcttgcaagatgtgttccagaataaactgttcctctgttgtctccatgcaactgccacagaactgcagaactgagttagtttacattagtatctgctaatttattattatcattccttatcggcaattaactggttaccttagagatcacctctctccccgtacaccttcactgaagttgagctcagccagagctcttgctaatcatcctgagatttttctccccaaggggctggaggcaggacattttccacagagggctctaaggctttggaattcctcttatcagaggaccacttgttttgggtccaggtggctccacctggttttttctctgattgtcagtcagacttacaaggtaggatgagctgcagacctctctctccctaaccttgccccagcttgtgctgtggcttgggcttattgtgcccagcgcagaagctaagggcttaggggattgcttgttaggaattaggggactgaaaaaggatgaagtcacctcctggcaaagctggagtctttcaattgtggcagtgctgtggctcttaggcgtctgcctcgagtttcagatgttggcccctctgcatgtgtacctcagcttccaggatttaggggaggccaagcttggttgaatcgagtgtctcagatttgggtaaataaagccgtttttacaagaggcctgtgtgtgagaggtgggaggatggctctggagcagccattttcccccacggagaagaggcttgatttcttgatgcgtgactggctggcctttgatgtgagcctcatttacttcgaacaattgagaggcttgaagtgaaaatcccagaggatcagttgtttgcagagggaaatgctcttcaagttacatttcctatttggctgttgtgtatttagagtagtttttgtgtgggctgcatagtggggtcactcagcttctagtgggtgtacccaggctgctagcacctccctgtgccccccaggggaatgatgaggaacattcctgcagctgtggggacagcaactctgccaactccgggagcttgagctcctgtgcagaaaccttacttgttatcattaggcatattggttaggaccacacagctccacagcatttctagaagaggtgtcagaatggaccagtgtttccactctacagtaatgaaaatggaaaaggcaaatgacttacccaggcacacaacatttgcggccaaacaagcctccattttgcttcacagtagttcctctggtgcagcttccaagcgttttctgtcacataatgaaaaacctgacaggactctctaggaggacctgcgggtatactttcgatggtagttgtgttcctgaaaagctggtcagccaaagggtgtttgttttgtaaattagaccccatgctaatcacagcagtggaattctgtatttaaagaaagcctgtgatggatcctttcataaaggagagtccttatataatgtgaataatcaactcctaactgatttcttttgtaagtctggattttcacatatcttgtttgcttaaaattagattcctcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtggtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaattagattcctcaaattgacaagatttacaaaacctttgaaaggtgggccaattcatttttcccttgattgaaatctggcccttgaatcctcactggttagccttcctgtttgatttttacttaattaaacaacttgcaactatgtaatatttaaaatatagtgtccagaaaagatgggtacgtgtcattgaaatttaacaagtattagcatttaatatttgcttcagattctaaaaaaatgaaataaaatatgacagctgccatcttcccatccttttctctcctttgtaaataaacccttggctcaaagaacagaagcccatcacgaatttttttttgtcttcacctgtagagctcgttcctgaagagatggcttcccctttgctgtctcagattatgaaagctccccaagtcagtaaggatttcctggattgggtagagcctgggaattactttggaaagtgaaagagctctcttagacttgcctttaaattcagtgtttggggagggagaaaaatcacttttcagaatggggaaaaaatgagaatgagagtgagacagacaaattgacagacacatgttaggtccagctacctacagaattttgagcagaccctttgggactgaagcaggcaggaagcttggtgtcaagtctgtgttctccttgagctcagtgttcatggactagcaccgcggcttctttttgttgttgttgttgagacggagtctcacttcgtcacctaggctgtagtgcagtggtatgatctcggctcactgcaacctctgcctcccgggttcaagcgattctgctgcctcagcctcctgaatagctgggattacaggcatgcaccactatgcccggctaactttttgtatttttagtagagacagggtttcaccgtgttggccagggtggtctcgaactcctgacctcaggtcatccacccgcctctgcctcccaaagtgctgggattacaggcatgagccactacgcctggctgcatcttggcttcttaatgttagatgcttaagcactgtcttgatgtgcatagtcttctgatgctccattaagtctctgagtgccagggtggccagttttcagtttctcccactgggccccatctggccgctgttctgtggcaagctgctctccctcactgccaccagcactggccttggcggtctctgccttctggattattttcgctcccaaatctgatttccagagcatgaagggcacctcttctcagattgtgtagtttgctcttctgagcaaaatggattccctgtgtaagccgacaggaagaaaagttcaatccaaaggccagatccctctttaggggagtttgtgtgtgtgtgtgtgtgtgtgtgtgtgtgtgtgtgtgtatgtatgtatgtgtatgtgtgggagagggagagggggaaaggagagagagaaagaagcaggagggaataaaatgaacattatctgcttctctcactcactttttttgcctctgtgatgatggagcctttgccggctgggctgaccgtacacatgtctatgatattaggtcctcagagcccccttcccaactctttgacattctgctggttgtctccctgaggaaatgctcataagcttagttacagcagggtgtgatcccccaaatgtgaggccatgacaccccaatttgatatagctcaaggatagatctctcagagactctttttaattgagatctcggtgagtaggaagcagccaaataatcattgctgtgcatacaactcagcttaagaataccttatagtgcatattttcaatttattagaaattattttctgaggcttgctttctctttttgtttcttttgggcacaattctgtatcaagctttcctcttctttaattctcttggcttgagggagtctgctatggactgcctatgtgtacaggtcgtttgctataaaaccatatcttttctaagtgagaagaatggacagggagaccctgtcaaactgcattcagagggattggcttaacctttaagaggcttttttataactaaaaatgtccgtaatctagcattcatatttgaaacttgacatgcttgagggaggcagggctctggagatacagggacgaacagaggcatatggctacaggtaatggtgaacggcttgttggaagactgatttcctcctctgttctgccaggcacagaggccatggtaaggacacagacacactgcactcataagactggcattgactatgagcttgctgttctgatcatttctttaattagtgcatttccattttttcaagtatagacttttgagtgatggagtatgctaatggtaacatttgttcctaaaagcttaggggagagaacacagtggcattcgtactaaataatggttttttcgtagtgaagattttgcctgattttaaaattgcaaaataattttatggtagttatggctttttggaaacgaatctcaaatactacatatgaaacaccaattttctgtgtggcttgtgcacttactaatggcatgtgtgtgcttacacttctaggtcattctattttgcctttactggtaattctttagaaatagaaaaagaagtgtgctttgttgcagtaaaaaatataataattttctgaaatggaaagaaagctaacctgcctttgcaaaaactatgcattatgtagtggcctgatggagcaaaaccttataaaactggtaagctataaataccatggcactgggcgttgttggaatgacatccggggcttggtctttgcacatctgatcaccaggtaccctcaagaggagatcatggaaggtggagaaaaatccgtacctgtaaaggtttgtggctatgcatggtgtcatatttggaaatatgggatcaaataaatgtgtgtgatgtttccaacactttgctgtcctcactctttgagcctagcaaactctatcaggacagttttctctagtgtgtgagtgagcccaagtgactgtatcatcaaagataaccatctagaaatctgcagttctgaggtaggggagatcactaccaaaacagatgaaacaattaaaaacctcataaaagagaagctttagtttattgaagcctgttattactagggaaatcagaatccaagacatagagaattctgaaaattccagacaaatgccaaactacaccaaacctgcaacaatatgtgaagagattgggttgggggatctccaagttatctttcagctctgggtgtaaatgtgtgaatgtttgcagcattggtttgaagggcttcatatagctgcctgcattgaagtttgagtccatgtgatgacaatggttgctctgtaggtggtattgaaggcagaggacttagctatggcaggtgaaacaataggtacagcacattagcttttaatgagggcagcatattctgtgtataatctgagttgtgagtgtgcatgccaaaactcagagcctctctgttcaaatatgtcttcctgtccaacgcgagttctgccataaaggcagcaatgggtattctaaccttgcttcatttggtttgtacttgttctagggatgaataggagatgcacgcgtcttgcctggcaaactagacctttcaggagagcacaaattcacttaaacataaattatgttgattatcactctacctaaaaatttatagagctggaagtcaccgagatctccttttaagttgggtattcttgaaaactgttttgtatatcatgataaattatctaaccttttatacagttgaaggccaacattatggaaataagcagctttttattccattctaaggtcagtctaaccaaattatgcaacttctaatgcagttgcttgaagcttccactttgaaagttttttcattttaataccttgcaacagagataaatattttagctactattcatgcttaacaatatatttcactgattgtcattctctttgtgggatttgttggcgtgagaggcagtccaccatgcctctgctcattttgatgtttgttataggttatcagaaaagagccagaattcaataaaaaatgtatttttgttcttgctgttatttttaatttcaggccataggaggctgactgagccctacagaatcaatatatacttggcacttggggtttgacttaagagccaaaaatgtggtagattttcttttaaactagatttgattccagaattattaaacccaatgcatgttggaggctgatggactgcatccagcaggatttggggcactttctgtaacaaagcaatttatttctttcagggagtcactgctacttcaggggaaggtgcagtcggtggggacgcccttggaagttctgttctatcctaggctccctaaacaataatttgtaggagctccttgatggtaggatcaactctatgcagtttcttttggatagtgtcaggtgtttattaaatgtattttgttactgatgactagctctatagtggttatagtgccctgctgttagagagtattcatttattctgggtcaaaccttgccctctatgatgatttgcctccagactttagtgaatggacttactgtttagtagttaggctctttaaaaaaatattttggcttgaaaatatccactcattcatccatccaccaaatatttatagatcatccttcactgaccaggcctgtattcagcccagagagacatagagaaagcataagtagtacctcaccttgtagtttatattgccactgaggagacaagatagaagttaagcacattttctttaagtcaatgagaaaagcagagatcatttactaaatggtgccatgtaattggttaacaattggaaaaaatatgatttatttcccactatatgacaaaaataaatttcacatttattaaagagttaatatgaaaactcaaataataaaatcattagaagaaaatataaataaatatccaattgattttgaagctgaagaggacttcaagagcataaaaacaatgaaaatgagcacaaagaaaaataccagcagctctgactatataaaatttaggaatgtctatatatctacaagtatcataaactaaattaaaaaataagccataagctgggaaaatattttaaatttatagcgcagagaacctatatttattaatttgtttttcagctttattgggagtgtaattgacaagtaggaattgtgtatatttaagatgtacaacttgatgttttgactcatgtatacattgtgaaatgattgccaccatcaaactaattaacatagcctttacctcatatagttaccattttttaaaatggtgagaacacttaagatctactctcctagaaaatttcaggaatacaatacagtattgttaattatagtcaccatgctagacattaaatctccagaacttatcttgtataactgaaactttgtatcctttggccaatatcttcctatttcccccacccacaacccctggcaaccaccgttctgttctccttctatgaagaacctgtgcttattaattcattaattaatgcttcaattatttatagagtgcttaccacatgttagtcactattcaaggtgctagggatacaacagtgaacaaaaatctctgtctccattgagtttacatttttatggacagatggtgatacgaagaaaaataaggaagtatgaagcatacatgttttgtcgagaatgaggattgctctaggaaggtcagggaagacatctcaaataagaggacttttaaacaatacccttatatataaagagctcttacaaaacaatgaaaagacaaacaccccaatataaaaaatgtaaaatgaacacaaatgggtaattaataaagaagccattcaaatggccaatagatatataaaaatatttcaaccatagtaatcaaataatagcaatgaactgctattaatttttaattgcaaagatgatgcctacttactactaaaaagtcaaggaacacaggaatgtgtaaaacaaaagttaaagtctccacaactatttcctcaccaatctgttacctcaggggaatcacagacaacgatttgatatgtaagatgtcattttgtacttatcaaataagcaaagattaaaaaaaaaacagtgatggcaagagtgtggttatgatacactgcaacatggagtataatttaaaaaattgatataatctttcctgggggcaatttggcaatacacattaaaagccctaagatatctaatatttctacttctggaatttatcctaaggaaataattttagatcagcgtaaaaattcatgtacagggttgttaatctcagtataatttatgaggataaaacatcggaaatatcctaaatatcatcaatatgttaatagctaaatatattatgatatatacatatgctagaatactgtgaagccagtagaatgttttgaggaatacttaattacacatgaaaatatggtataatatacattaattgaaaaaatcagaaaataacacacatagattaattccagtttaatgtatgcatatattattccaattgtttaactataatacaatatataaatatatataatatataaacaattccaattgtgtgtatatatatgtgcgtgtatgtgtgtgtgtacatatatatattcatacacacacatacacatgcacatatgcacacacataagactagaaagaaaattaccaaagcattaacagttatctcaggttgtaggaagtcaggcaatttttactttttaaatggtatacttttttaattttccaaattttctgcattgaacatgtgttatttttgacatcagaaaagcaattacttaaattaaccgtaatactatgcagtaggtattaagggccaaaaaggtggcatagacagtttttaatgagttattccgaggaggggcagaccaaaatgttccttattttcattttccaattagatcataccaattttttcttcttaattttcttctcttggaggtctctctcagaaggtaacaagtatgaagttttacattttaaaataactattttatttacagtttaccttttaaatgtgagaaatgttatgaacaatatttgtttcctttttcattctttttgtccttgtgtatactcttgtaaaagtagatttgatttgtctcaccagtgttagacatctagttcacatactttatttttagaatgagaggttttaaaatagtaaaatttaactgcaacttatacatatatttaatactatagaaatgatataggctttatctaagggccacttttggcaaaatatatttttttcagtgcccttttcagtaccaaatggccaatttggagggaagtgcttttttagtattctccaatacttgatttcatgttcttgcttctcggctctgaagcatcctgtttcaacatgatagccccaaccatgtggaacacaaaaaagaaggagtcaatgatttggtggtcattgagatgctaaaaattttaaattcaaccttgactaaatgcactatttgtgttcttttttcaacaaattagaatgggttcaatccttttctgaaaggcagatttatttgattgcttcctcatctagtaacctagttttggacagcataaatacaaaagccaacatcctttggaacacctctttaattgatggctgtataaacttctcacatcctaagcagcacagttaagggcaaaatatttaattcagtggtcctgtgtagatagacatcagaactacttagatattgtaaagaaaattctcatggaaaaaaaactcacacagatgcttcactctccaccccatagccaatgcatgagaaccctgtacaacatcactctgattgtgaatgaaatctttgctacaggaaagtgtctgtggcctaattctgtagtctgtcccttggataaatggagactatgactttcagcaggactatatatttcttatatgtgcaaccatttaactagatgggtttaaatttgaattataaggttttcatgttacagcatggagcatttgatagaaagaaatatcttgattttttcatgtgagtgggcatgaaagaagggtctaaaaattgagggacctcccaccccagcctcctttgtagttcagttccttaaagtaaaagtcttcatttaaagaagtattgagaatgtttgaaacttgattatggagcaacttaagattcatattttctcttcagatggcttaaagttgagattgtttggattagaaaagaatttccatgaaattaaaatatttaattgcagttaagccaggatttggaaaaagttaatgtgataaagcagagtgttctagctgaaaaaaatttatgtaatattatgtaaattcatatcagcatgaaagttaatataaaaccccagaaggtgataagaagatcgaaagcaaggaattttgtttattgaattcaaattctatttacacttgccaatcagtgagggttttggactggctgtgaagagagccctactaagcacacgatgctttattcgatgtgtgtgaaggcctgactctgaacttgcttatgggccccagacagaccaaaaggccttgaggtacccttagctcccaccctccacttcctatggctgctgttcgctaggtcccaagaacagaactgatgggatgatgtgactgaaatgtttttatttaccagtgccgatgagggagatagaaccatgtagggagatatagatacacaaaagctccctgcaaccaatactaatctcaatgagttggtatttttgaaaacacatatattaatgtcatgactaaataaatgcccaataaatgtttgttgaattaatgagaaaaacatccatggttttaatgttttaaaattttagttgagatcattctatttctcttttctcatctttacattatgttataagattttttctttttttttgagatggagtctcactctgtcacccaggctggagtacagtggctcgatctcggctcactgcaaactctgcctcccaggttcaaaagttcctcctgcctcagcctcccaagtatctgggagtacaggtgcctgctaccatacctggctaatttttgtatttttagtgagacggggtttcgccatgttggccaggttggtctcgaacacctgacctcaagtgatccgcctgcctcggcctcccaaagtgctgggattacaggcatgagccaccatgcccagctaacatttttttctatgtcattagagaatatttataagcaattttttagtggctgaattgtattctgttctacagatagggtttagttttactcaaacaatcgctagcattgaactttgaggttatttaaatttttgttttatataaataacaccatgatggctatccttatatataaattttgttgtgatctctgattgtttgcctgtaataagttctctacaagtgaaattgttttatctgagggtttatatatttttaaaagtggtatttcccccagataagttgtagcaatgtgtactcccactgacagtgtatgaaagcccatttcactgtactggcaaaacattattatagttttaaacgtcaccaccaccaatctggtgaagctgtgggaaaacaggcagtcccatgcattattggtgggagtataattttttttttttttttttttggagacagagtctcactctgtcgcccaggtctgagtgcagtggtgtcatctccattcactgcaacctccaccttccaggttcaagcgattctcctgcctcagcctcccaagtagctgggattacaggtgctcaccacaacgcctggctaatttttgtatttttagtagagacaggttttcaccctgttggccaggctggtcatgaactcctgacctcaggtaacctgcctatctccaccttccgaagagctgggattacaggcgtgagccaccgggcccggcctgggagtataaattagtaccagtcccatagagggcaatttgacaatatctctcaaaattacaaatgcatgtacactttgacccagcaattccacttttagggatttaatcttatagatatgcttgaccacatgaaaaatgatgtatatacaaggttcttcattgatgtattacatgaaatagcaacaatggaaacaatgtgtatgtctgtcagtggaaagttttttttaaaggagtgttttatatattgatatggaaaatctctaaatatattgttaactaaataaaaggaagattcaaaaaaaagcgtagggcacactattatttctgtgaaaaagggagggaaaaagagaatatatatcttattggtttatatatacatgaaattgtatggaagaataaataggaaattaattagaatggagacctgttgggagaatggccaataagaggataggggacaggggtgggaaggagaattattagtttcatagatggaaaatgagtatctaattttagtggaaatttgtatttctttgattactaatatatatattaaggtaaatccctggtttaatttattggaaatacttttcttcagtttgttgaatgacttttaatttgttatgcttatttttgacatagtgttttggaatcatatgaaaaaacaatttgtcagtgctttaatctgcgatttcttctgttgcttttaagctattcaactttctaccaacaaagagactatatatataatatttcttccagtatttttatgaattcacttttacattacattttaaattcattaggaatttattttgacatatagttggaagtatgatgtaaaaaacattttcctagatggttaattggttgagtttgtaccatttattgtttatttcttcttcttcaccgtaactttctggtgcttctgaaaaacatgttgagtttttatagagactaggccctttcctgggctattcatttattttccactgatctgtttgtctactataccaataccacactgatttgattattgatactttataatagattttaatagatagtaggtttagtttctccttattctttgtctttaaaaagagtttcaatttttctgtttattgtttcagatgaactttggagtcatgttaagtctcaaaaatgattatgttgggattttgattgaaaatgtaccaaactgataaatttaggaacaattgacatgtatataatatttagtctttttatctagaaatatgacatctttccatttagtcatgtttcattctaatgtcatcagtatatttacatagttctccttacattttttgttaagattacttctggctatttaatggtttcactgttattttgagtgggctctttattccattacattttctaatcaggcaaagctggcagagtacatacgagagctcttgacttttgcatctctatttcgtatggagcgctccatgttttcttagatacggtttgtcacttgagtgttcatgtaatagttattttgatttattgcatctttgcttttagaagttagagtcaggagccaagtggctttagggaaattacttcctctctgtgcctcagctttcttatctgtaaaataagagtaatgggacctacctcgtagattcttgtgaggattcaatgtgagtgttcaagcacctggcacataataagccatcagtaaatgttaagtagctattactattatgatctctttttgactaggaaaatatctaatttgtgcctcttaatctggaaggaggcaatcagattcttactgcctctagcaatgtactgtagagggcaacacaattgaattttgaaattaaagaaaactttcatttgcctctattctgttactgcaaacaaattccacctcagtgtgcttttctgcttttagttacacaaattcctttttacatcacagtattcttttccttagtggctccttcagagtttctcattgttccttactgtgacacccatctctagttcaaatgtgaagtgggaggaggtcctacgtgaatcagagttagctagatgtgctggccagagagccagaagccctcttctgatgttatcccttagtattttctttccagagtcagtggatatcaatttaggccttaatctggcatttttcaacctttctcctgcatgactctgtgctgggtatctccattagctaggaagctctggagatggcaatttcatggaccactggcttggggttgtgacctgcactttaataaatactaccccaagcctttcttatcctgtgacctgctgcttccgcagacctgggctctgtttcagggccactgccttttcttctttctttcatgcaagtgacttacaaatgaattttaaatagccagttcatggtgaggaacttttgagatcatgttcccaggactatgctctgtctcagacatgttttacttctacccaggaaaccagcttcttgtatctcttatccaagaatattttatactcttttctcaattttggggtgaagtgtagtggcctagggcagggactccaatttcactttggcaacttgtggaacaatttatgcttgtggggggttttaaggaagtgctaggtggcttggggagggggagaacaaaagcttggttatctgttataatatttaacctgaatgtgaaatgtgtgaactctgccaaacagagtctcactgtaagtgaagcattgccaagaaaataataggtaggtggttgtgtctatttctttttttttttttaaattactggatattgttcccaatagtcagcagttgagtactaaccattttctgttcatttcagtacaggctgattattttccttctctagcttatagagttgtaatccatgcacgtataattaaaatgatatccaaatgcagttttcctttgaatttgtagtggctgtgtgtgtagggaaggttgttgctttgctataaaccacagacccagagtaaacctcagctgtgctgcagctattttggacgacagctttctagttgcttgtgtgtaattgcccatattacatcatcccaaccattgtgaaatgtgcaaaatacaaggcttatctaatgattcatttcaggtggacagtttcttttaaattaattttaggagtggttctctgcactaaacagatctccctactttgttcttgcttttttgttcaggcctacggtaatttaatggttgataattgatgtagcagagagaagtgtatcatattcattgtgccagtaacctttacagtctacctaaaatgttccatgggatgtgctttctcttggcgtaagtaaagaaccaaggggagaaaaattccctccacagcatatcaagtaagcattaacctcaaatgaaattaatttccctgtcattgagtagcagagaaaaaagctatcttcaacggctacaagaggcttggtcttactggggtttcagtttgtcatattatactgtctttcattatcacagacatatactatagggaagactttcaatgtctctgttggtggattgcactaactcatctttaagtcaggtatgtgaaattcaagtaagccaagaccttccagtttttttcttatcaatgttgaacattcataggctaggtaatattacatgtttagtcacctactagtaagatgaggtgtttacaactaatatttatctttggccttggaccttctacgttgctcacagagtacagttttgtaaaatgctttataggtaatatttcaaagtggacaaaaaaagaagattgcttagaaccagaaaggtcagaaatagatcaaataatcctgggactttttattgctgaataatggactttgtaaatatcacatgtgactattagaccaaatgagactacatagaattcaatattaattggttcagtatccgctgatggcctgtttgcaggattcaatgaaattatattatcaatacaatgttttattgattccttggtttgcaaaattaaataaacatagcgtaagcacttgcagtggtaagttgtagcagggaaacgggttttgatttggaatttgaaaacaaaattaaaggtgattgaagcagaaagcaggctgtggcataacatttctgccagcacttttgaagtaactgaatatatctgggtgtttgggaggaataagaatcagagaacagagactttggaggaagtgtttcaaaatgctttcttaagggttatttcaatactagcaactcattttgttgaatagtttagtttgctttactatggatatattaatttatttcattctatgctatttttttccagtatctatgccattctttgtgttgttctagataatggctaaatagtggtcagcaaaactgacatagtcccctgccttcatggggtggggggacaaaacaccaacaatataaaattataatgctatgaaagaaaagagcatattattatgaaagagtaaaatggggaaactcaacctagtctgggggaagggaagtaatatttgagctgacccttgaagggtgagcaggagctgtgaggcaaaaaggtgggggacaggaagatggttgacggctggctgttgacattaaactcttggcctaatctcagggaaccatttcccacccctcccccaccaaggtggtctgaatttgagtgccaaagtcttgaatccaacacacagccattcgttaaaaaagtggaaagaggctgaggcaggaggtggtggttgtggtaacacacagagtctaccatgaattctgaaaaaatcaaattcatttcagaaaagcagccatgaaaagaatctgtttcaaagtaaagaaagaagcagcctgcagccagcttcagatggatggtttgtggctcaaatccattcctccagttactgctcgatggcccttttgagtccatgccacctcccacccccaaccaatgtcaatgggtggtgtgcagatgcagctcagtaagatagtgttttagggcatgcaaggctcatctagtcacatttataacatagaatcagagtactgtcaaggcaatatttatcattttatattctttcttggctactcttgataaataggaggtcaagggcctcttcctctttatattccctctggataaacagacagcagtctccagagaagaaaggcgtctttccttccctattttctgcttccaatctgtttctttttccctctttctgctccaactttttttctgtgacgttctgtctgacagtcagcagagggcgtatagacgcatcaaaagccagcctttattcaacttggccaccgtaatttcattgtctttatctcttcatctttacattcctcaaaggcagggatacatcctggcgttttctctttgtaatagtaccatcaagggcaaccattccttacctattttataaaggtgggcaaaagctactgtctagataaagggaaagaagttgtgttcctgagagctgggaggaaatgtgtgtgtgtgtgtgtgtgtgtgtgtgtgtgtgtgtgtgtgtgtatgtgacagatctcagagttgttggtgccctacgtgactcatttgggaaggactcgttttgccaatagcaaagcagacagtctgggttcctcttcttctttgctttcccggggctgttgtcctgatagcagctgccctgcttcctgacatgtcctaataatgaagatgatgtggccagggggagattcatcttcttccctaatctgacttcttcattgaattttccccttactgaagtccaaagaggattgtcccctcttaactgtgtgccctttttactctgcccaaggtcagagaatccagctgtggcctgtctgcctcccacatctctggctgcagagagtgatccatgtttgtctgtgacagctgtgtgaatggtacgtgagaggcagaggagagctgtagtttaagctgctccaaagatgtcttggtatggcagtgctgacgaaaggggagacttgtttgtgtcgatgacataatcagagaagacatccatggcccagctgcagggagtgaagaagtgtgcagcttagtatagtcttctgacaaaagcccacacacttcaggtttatctgcccgtagtgctaatctccttctgatgtcttaacctgacttttgttgtagtttgttcagacggttccagtgacagaaagaattgcttggcttgtggtggttatactggctagcacgttaatacaagtgcagggtgttttataaccaactagtctcataataactacacatgaagaacaggcaaggtttagtttagcatattctgcctattggaaagcatcagacacggttatagctcctcataaataatactgatggctcctaaaggccatttttcatgtaaatttccttactgttagtgagcttgaaaaagaaccgtattgacgaacaggttattttaaaagtagaatgattactcaataaaatacttttcagctttttcctttggggctctggggttcccccttatctcaaggatccacgtgggcagattgcatgttagctggagaacccaatagacacattcttatttccatgccagcaaaacactaataatctaaacacaaaggacatttaacacagtaactgtttctgatggagcaagtggtactgccagctcgctttctcttggatggcttctgtacggtgagagcaggattgggagttgagcccaggctactccttagtttgtgtggtataaatgaacaacttaagaatagtgtttgtatagtcagggtcatttctgccctttctcaatggacttgaaatcctgggctgaatatttatccagcttggttttgtgtttttggaacaaaggaaatttccagtgaccagtctggttaatcaccaacgcttattccctcttcaccactatttcgtattggatttccttctataccagtacattggatttccaatcacatcgaaccctatttggctgccttccattcacagaagattagattcccttacacctcactgcctctcaggatttttctctccacaacgtgtagagtattaggttcccttacatgagttgctgcttgttaagttgtgttcagtgctgcgtagtatcgaattctctttctcatcagcagtcactgggttgttaattacacacttgcagattcacttctcctgcacatgctgtgacacacagctctccaaagctctgaactcacacttcaatgccttagccatatctgcccagattcagtttacttcagctgtgtggtattgaacacctatgcatcagtctgggctagatactgcggagtttacaaaaatgagtgctgaataatccttgccctcaaagagtttacaatctactggggtggatccagggcagggcagtgcataagatgaagaattatgtgcgtgaaggttaagtattggttttactcttttcctagaaacagtttagtatctggcgtatttaaagcaccttagaaggcaacatgttcatcataatgccattattgccaccattctgttccataatgggaagaaaacattaaaaacacaattgtgtgaaaaaaaacccttttaccaggttccaatgcagttattggtagagttggtagaaaactcttaggtctcttaacaaactcttttaacagccctgccttcatacagacttaagacagtattagaaatcatataattctaagagacataaattaggcatagagaaataaacattgctatgtagactgtgctctaacatgccttgacattacttgcaaactaggatctatctctgttgtatttcttttggtaccaaaatactgtgcaattttattcacccctggaaagagagggaaccaaaagtaatacaaagtggagcaagtcatggtttcccacaagcaacagaaagtggagaaggcattaccagttgtgattttattgctcagcattctcaacttcattgcaaattcacaatctagtgtctcacaatggtgtaaatattgcctaataccttcttcatgtagcttctcattccttgaatgcttaacatgtgccaggcactgttccagatgctttactgtagaatcccagttattgctcatcataaatgaatcttctctgcatttgctgtagataaagaaaaaaatctaagttactggcaacaaagggatgtgtttttatccctttctgccaattcaaccagagcacttcattaatgccaaatttctaatttgatgtgaacagcactcctagcatagtctgaagcttgaaatgacagtgatttaaaaagaaaatagtttagaaaaagacctagctaataagaaaagctatttgctataggaattcagtaaaaacccaagctttggtttaagttttttctttaacaataaaatattgtgtcattttaaaaaaaatccctggaaggaagggaaccaaaagtaagtcaaagtggaaagaggtcacaggaccaatgcttttgctgtctacccaatcttttctaactactcatatgtattgtgtgtctaaaattcagagtatgatatctgtcttttcttttttcttttcttttctttttttttttttttttttgagacggagtttcactcttgttgcccaggctggagtgcaatggcgtgatctcggctcactgcaacctccacctcctgggttcaagcgattcacctgcctcagccgcccaagtagctgggattacaggcatgtaccaccatgcccagctaattttgtaatttagtagagacggggtttccccatgttggtcaggctggtctcagactcctgacctcaggtgatccacccaccttagcctcccaaagggctgggattacaggcatgagtcactgcacctggccgatatctgtattttctaacctaattgtgtagcataaagagactttattagtatggaaaagtgacagcaacatttagaactcatttttcaaaggtgtgttactattcaaagcctttggaccatagcaccatttcattagaataatagcatgttgatcctcaattgaaatgccctactttcttgtccatggttatcaccagtagtcagggaggttttcttttccgaggcttgtctttaatcatatagggcttgggactgtactagttcaaccactgtggaagacattgtggcgattcctcaaggatctagaactagaaatatcatttgacctagccatcccattactgggtatatacccaaaggattataaatcatgctgctataaagacacatgtacaggtatgtttattgcggcacgattcacaatagcaaagacttggaaccaacccaaatgtccatcaatgatagactggataaagaaaatgtggcacatatacacaatggaatactatgcagccataaaaaggatgagttaatgtcctttgtagggacatggatgaagctggaaaccatcattctcagcaaactatcgcaaggacacaaaaccaaacaccacatgttctcactcaggtgggaattgaacaatgagaacacttggacacaggaaggggaacatcacacacctgggcctgtcttggggtggagggagggggtatatctaatgtaaatgacgagttaataggtgcagcacaccaacatggcacgtgtatacatatgtaacctgcacgttgtgcacatgtaccctagaacttaaagtataataaaaaaataagaaaaaaatcatatagggcttaatatgaacatctagacacagactttattcttccctaatgctgtccccaaacctttctggagctcctgctatgtgtaatgtagcatgttcctaccttcacaaacattcctgccagggcatgtacttccatagctcaaatatttcatttttttttctttttttttgagatggaatcttgctctgtcgcctgggctggagtgcaaaggcatgatctcggctcactgcaagctccgcctcccaggtgtatgccattctcctgcctcagcctcccgggtagctgggactacaggcgcccaccaccatgcccggctatttttttgtatttttagtagagacggggtttcactgtgttagccaggatggtctcgatctcctgaccttgtgatccgccagcctcggcctcccaaattgctgggattacaggcgtgagccactgcgcttggccaaatatttcatatttcatcttcttttgaatccaagacttgtaagcataatttatggatgatggcttcagagaaacaatgagttacaatgtatcttatgattccttggacatgccttatttaatggtaaagtttccattttccccctgttgctcatttttagctataaagaccataatgccagtcactgcctgaaatctagccaccccctttcacattaatattaatagcataatggcaaacattctgtacattgcctgtgactcacataatcaccatgcaaaatgcatcattcataaattgtttagtgcgacctttggcacagtagcactaattattattatcacagaagcccagtaaactagactggtaattatcagggatttatttgaatggacagctaagctattcttggcaagttagtcaaagcagttgtcatgacagccatacaaatatgtcttatgaattgggttaattagggtaattaataactgttatttgttccccttttcccaagatattgcctcagcattatcaaaagggtgaggggtgtaaactttaaaataatgcttgaatccttctgctaagaaagctactgacgaaatcaatgaaagctacctaccttccaaaggtgctcccttagagaaaccctcatttttatgggaccttctcctacttttggatgtttcagagtcagcaagcacaagccatactgaaaaaaagtagttaaaaagagaagctaaatagtcagttccccgaggctgctgctttccttttagtcacctgtgagaactcccaagagaccatccctctggcttctacttttagcagagccctgctttgttttttgctcatctagaactttcttgccttgctctgcagcctgttcattgtataatttttttttcttatttttccctcacaaggaaattctgagtttttctcacccacatttctgcccctctgaggttttccaagttttaattttgttggaggccttttttaatttaatgccttagggaccatctaacattgcctgatggtggttttgctcttttttcgaagaaaggaaaataggctagctctgaagagctttctctttctcttccttaaaaaagtaaaggataaaagtccaagtttcttctctctgcatcacagcatattaagttgtttttcttattctagtgcaaagaagagagaaagggagaggttaaaaactgaagctgattcttttccccaatgagatgattctttctttcagagtaaatgttgttcacaaaaggactttaagactttttgtgatggttttgaacagcaaatcaatttctctccatttcctgcataaaactaggagaaggaggctgggggaggtggctcacgcctataatcccgagggaggctgaggggggcagatcacaaggtcaagagatcgagaccatcctggccaacatggtgaaaccccgtctctactaaaaatacaaaaattagctgggcgtggtggcacgcgcctgtagtcccagttacttgggaggctgaggcaggagaattgcttgaaccccggaggcggaggttgcagtgagctgaggttgtgccactgcactccagcctggcgacagagcaagactccatcaaaacaaaaacaaaaacagaagagaagggacacaaggcagaaagagaactgaggatgttaattaaacatctaatctatgtcagtttctgggctcagtacttttcatatattaactaatcctcccaacaactctttgagactggaaacattattatcctagctttacaggtaaataaactaaattatatgaaagttaagtatttttctgagatcacacataaacaggacttgaacctcaagtctctgatccagagtctcctttcttctacaccagctagaacagagtttccccaaaaaagcaagaggcttttagtacttcatgaattccagatgccttgctcacgccacaaatttctattgaatataaatgcccatttattttgtttgtttcaatgcctgttcagcaattgagatttctaggtcagtgccagcattctggctgacccataaaattcaagtttgggaggaattctggtaaaatgcttttagcagagggtgttagattaataggttagaaaaagtgccaactttcttcccatgtcatactggaatctcatgatcagaaggtagcttcctctattttactttcagttgccctgttagggaagaaaggctttctattgcagaagtggcttggtggtgcttggaagctgcacaggatatatggaagatggagtggtttagggttctccaggtgtccctgtcctactaagtcagagatcaggatcaggttctgacatcttaggaagctgaaaactgacacacagagacccatttcttttttctttttttctgaggtggagtcttgctctgtcacccaggttggagtgcagtggtgtgatcttggctcactgagcctccacctcctgggttcaagggattctcccatctcagcctctcaagcagctgggattacaggcgtgcgccaccactcctggctaatttttgtgtttttagtagagatgaggtttcaccatactggccgggctggtcttgaactcctgacctcaagtgatccatccgccttggcatcccagtgtgctgggattacaggtgtgagccactgtgcctggcctccatttcttgatatgttattattaaatgggccatggtatcatatatttagtatttttaagttttgtgtgggtgtgtgtgtgtgtgtgtgtgtgtgtgtgtgtgtatagtcatttgtctcgtccatgaaggaccttcattcacttgataaacactttgtgccaggagctgttttcagggttccaggaacagcagtaaactaaacagacaaaaaattcctaacatcatggagttaacattctagcaggggaagagagataataaacaaaataaatatgtgaaatgtatggtattttagaagataagtgatatggagaaaaataaggcagaaaaggaagataatgagttttggagaaaatttgcaaatttaaatagggtggttaggtaaggcttcaatgaggcctaattttatttcttaccacttcacacacaaactttcttctccagcaaagcagatggttcattcattcattaatgcctactctacctacctttatatcctaccaggtatagaatacacatttaaggacaaaacacacttgcccctacccttttggagcccaaagtacaggagatagacgttgaaaaaaataattacacagataattacttgcaattgtgataagtgtgatggaagtagtagaaagtactaacacatactacatatggaggccaatacacagctactaattgtattaagctaaaagccacagatggaccaccaaacatttggtatccctggattctagtaggaaggaccacgatgacatgattacaaagccacaagtctcatttggtttaacctgtgtctagggatctgtgaatttgtgatttcaaatgtttgattgccataattttattagaaaccttcagcctccaacctaggcaattactggcatttgagtttaaacacatgcatacacacacacccacacacacacacacacacacacacacacacatgcacacacactgttgtattctttggaaaacaaatgaccttttgatttggtgtattgtggaactgctagaaaactggcttagaaggagggaaaatgttaatgaaggtaatggctgatttttagagcagagtacctatttgttttttcttgtcctttcattgtgcctccaaagcttcaaaacctcctaaaaatgaaagattataggaaaaaatgcatcttttactttttaaatggtagacagcaaagtattttaatgaggaaatatattatattattctcctacaaaccaagggctaatagtctggaactggtactttggctgcataaaaagtccagcaagacaagccaattatggactctgaaacatttttatttttagttccttgtaatagcgattcattctctgctatggtacattaactgggaaacaagttgaaatgagagttttggcaactttagaataattgactatatttaccaaattcttaatcgtgcagagaggttagcaggggaggggcatagaagaacaaaagattaggtcagggaaaaatacgtctaggagagtctgactttcaataaaggctaaatagacagctttagaatacagttttagagaactcttttttcctttcagtttattcttcaagtagacaacagtttggttatttgtgctgatttctgcctttatgtatgatgtggtgttacttttgtgagcagaagtaattagttgtttacaaatgaagaatgcagtaggcacagctgtgatattcttttccctaccacgagatctggtagtccccaaatttccctctacatctgtgtgcattggtaacactgttaactgctctgttccctttcttttccagtagaatttcttttgtttgggatgactgttacttttccttttggtcctcttttccttcagtggctctgcttgcctatctggtggtcgttttggaagttccaacccagcaccaatccagagtggagctggtgatgccgaaatggaaggagtgtttgggaagggtagatatgttatgagggaatcacgttgaagttaaatgaaccgctaaaacaaatgtaatcttaggcctcattaaggaggtatagttttctgattataagaggtattagtccctctgaattctttgctgttaagactacatctggataatgatgtctgattctggatgccttattttatgtgaaacactgacacactagaatgagcttcaagggaggttaagagactgataaacggcctggagaccacatcacttgtggaacaatgttcatactgcttaattatgagagaggcaaaaagttgtatgaagccaaccttaacattgatctgcagtaggcaaatgtgttgaaatgaagagactaaaactaaactttcacaaaagcatgacacattcttcttagtgtttggcttgttaattagttacgttgagtacaaatatttatagtatttgagtctaggaccagctaactgaccagcacaacagctttcacatactcagcaagggcaattcgttcttaggtataaggccaaagactgacccttgggtgatcatggagatttcccttccctttgtagagtgctctgtatttaatcttctaatcattaaaaaacagatgctcaccactgacagaggtggggttcctagaaaagatggactgatggctgttatgctgtcttccatcttcttgagacccttagcagctttgtagtggtatgctttagtggggttaggaaggagttaatatcttggaaaaaccttggatgtggcttgatttcctcttaggaatattgagaagatgaacacatagtgggaaatttttaaatttactggtgctacaggcttttttccaaaaggcatttgtagtagtaataataatagtaataataatatgcccaaatgacagaagaaatattaacttctgaaaataaaatttcaaaaggcaaattttataatatggttgaccaccttattctttttagatcacctagggagaggtcattcatacctttatttattaattctctatcttctcatgccttattgatttacttttccaaagcacagcagaggaaactttggggggaagagataaaagtaatccctgtttgcacagcaacacaatgtgtacattgttggcttaaggcctgtggtggacagaaagactctggccttagagtccttcaggccctcttatccaggaagagaagacacagaaacatcgttctcagagtagagacagtgtttctgagcgacccaagatttctcgtttcttcttgtgaccttcttcctcttttgggcactgaatggggtcaggcctctagggatggcacacagttagttggtgagagacaggaagggactcagggtccagcagctcctggaagggagaaaggtgacccagtaacttttcagcttcttttggagaaaaggcacagtgtcaagcaatcaggagaggaagaaaacaagcataaaatccacatccttaaagtccataaatggtgaaaggaaagctctctctgctccccaccaagtgtggaagttttatggtgtattctctattcatagggctgacagagagtgggactgacctgctcaggaaggtgaaggtctccacctacaggctgctgcaggaaagagctcagtctgcctttcctatccttgacaaggggagtagagccagttttcagaggctatccaagctagggttgacttgtctcaggactcatctttatgcaaagtctgcaaaaagaatttgaaattcatgaacatctgaccactggagaaaacctttactggctcaaaaaataagtctctgtggtttaattagctaccccttcggatattgatttttctagcacttgtacagaatgtaactcatcttccaaactttacggaagagccaacccaaatccagctggatttgtggctgtagagaagttgcttgattttattaagcatggcttacgttctgtctttctctctcccctgacatttatatgtaacttgcaaaatccaaaatcacagctagagagaagcaaactcttcccccaaaccaaatattttccctaggtctatcccccttagatcatatagtctgagggcacttctgatggcatgtgttacccatggaggctttcttctctgttgctctctcctccgtgctcccatggcacactgtatataccacttgctatggcctaaatgttggtgttccccacaaatttatatgttggggacctaagacccaatgtgatagtattaaaaggtggagcctttaagaggtgattaagtcatgagggttccacccttatgaatgggattattggccctgcaaaatggctccagggaaccaaccagcacctttttgtccttccatcttctgtcttgtgaggacacagtgttcctcccgtccagagaaagatacagcaacaaggtaacatcttggaagcagagagcagctctcatcagacaccaaatctattgataccttgatctgggacttcccagcctccagaactgtgataaataaatttcctttctttataaatttcctagtctcaggtattttgttatagtagcacaaatagactgagataccactatggtagcacttacaaccctgcattataattgtctctccatttaactgtccccagcactagaaatgtgaactccttgagggcaggagtggaatcgggttaatctccagatccctagcgtctcccatggggcctgacacatagtcttaacagtatttgttgaattgaattaaattatttcagccctgagctgtacaagctgtcatttgttctgcaacagtcagtcgaggacagctagggagcatgaggcaaatcttttcaattgtggggaagcctctgaatgatctgtttttgcctttttcttctacccttctcatcgattccatctatcccttttcattactggttgcctgcaccttgtgcaaacagaagtcttaaacagtgcaggatcttcagtgacttttttgtcttttgatccggggctgatggcttttcattttactcatgctttatatggcatagtcaagtctgattgagacttatttggtggtagggcagtcagaattactggtagaaaagaaatgcaattttattactttcaagttcatagaatgagaagaagtagactaataaagtctgtgccaggaagttttgccaagtagaagtccttggacttgttttaatgaataaataagaatgatgtgcaattaacatacttattgtttgtaaattgcttctaaagtgcctaaaaacaatttattcttgttagtttaaacattttccttgtaaccttgtttataccacaatttgcccagcaaacctttataaaaatagaaacagcagcctagctctatccgaatgctcaccaaatatgaattactgaaatctgaactgcaaaggtatgactccaacacgggaaagcaagtaagcctgagatggatgcttttaggaagtgagcagaacagattttcccttttctacttaggtgttagttgcaaaggcagaaggttatagttagttgctcagtactatttagagaggaaaaatgctcccttcaccagggagcaatacttgtcatcattccagctccccttggtggtctaatgccagagagtttctttccactgaggcagtaaaaatgagaaaatttaccttttagataatttcactacgatcaaacaatccccagtgggcaaaactaatagaagatactgtattttgattgcagtttatctctagcaattataaatgagcaatttaagtggcaacaaagcaagttgtttgctagaatgaggccgtatttcacagagctttatcattcaatattctctggatcactcagctaaaggcagtctatttccttgggtggatcatacatcctctttctacagtatccctaggaacaattacttttcttaatgatagggtattgagaagaagtgatctacaaacataatttacactaattttcacttttttcctcccatgagaaatttagttgacaagactttgagtattaggttttattcttccaggatttcttaagagaactaacaagaaggagctgggcaagtagagagaatgtcagaagagctcagttctgaatccatgcctgagtttccaataaccagctgcgttgctttgggggtggttgtaagtttctctgggcccatttccttatcttcaaaatattgtgtgtgtgcacgcacacgtttgtgtgtgcgcgtgtgcaagagagataatagattagatgaactctaaggtcatattgaattttaatgctttacgagtatatattctgtgattgttcatgagcccaaaggggaatttttcagtttttcaaagctttcagtggacagcatagcattgtcaggttgcagtaatgatttcgagaacctttgcaaatgactacatttggcaataaagctactgtaggctctaccatggcctgaagaaataattaatattgcataaaaatatatattttttaatttatgaaggatagatctcaaaagggactatagattgaaagcagaaacagtaagtgagccaattgggcttccattttctactgtttataaatttagactgggtggaaggtcccctggtttggaaagaaggagtcttaggttcttgctctgactctgccagtaattggctatgatcatggattcagaaacttttgggcctcagtttttccatctgttaaaaggggaaaggagtattttgcctatatacatctgcagactgttgtggttattagaagggagcataggtcaaggctttgtaaaaaaaaacaattgctatattaatgcaaggtgttatttgagaaaataatttttaaaattgggacattgagatacacagttctacaggtgtttctcattgtgctagattgtgaaacattgtctttgaaggtgtggattatatcatgttcaatattatgtatattacacattggcatttcaatggaatgggaatagagggatggggaaacaacattagtttggttttgacttaaagccagttttttctactaagttcttgggaaatgttgaaagaaatacaagtctaggaagcacatcagcctttcttaaaagagctttgcaaactttgcatttctgattcaatctatgaaagagacaggtgagaggttcctatcagctgttaatcagttaaccaacagtgggtgagcatttagccagtgccagggacagtgacaggcactgaagataccaatactaaaggtgtggttcttgcccttaaggagttctccaacctagtgggggtgagatataactaagcaacacaatgtgttaggtgatgtgatagaggtaagtatattccttatatttccttaggtaacatttcagaaccggcgaatcctgggtgacaagcctccggtttctctctaaggtactgctgtccagtagaactttctgtgatgatggaaatgttctatgtctgctctgtccaggacatggtagccacatgtggttactgagcacttggaatgtggctactatgattgaaaaactaaaattttaatttaatttaaattttgtgaatttaaatttaactagctacatgtggctaatgtctatgctattggacagcacccccctgaggaatggtagtgtgagcccacagtcaggctccaaggaggtcctgagttggatcatagaaagctctggtcaatttgcccctgtcctttaaccctgttttcctatccaaatactgcactagcccttgaatggctcctttccagccgacaactctgaattatgcatgctaatgtgtgttactcaaccatggcatgaggttccctcactcccctcccccaaccctgccgtaaagaaagggtactctgtgacagttcaatcatgatgaaggaagaaaatgggtcgaagaaaactagtttataaaagcttttaaaatgtctgaaatcttgcttttcacataatttcagatggtgtgaggtaatttcaactctctttaagctgagttttagctctctttctctctccctctccctctctctcacacacacacacacacacacacacacacacgcacgcacattctacctaaagtgtctgctgtggtagatggggctccttgtattcctattgaatcagcaattagagaagttgggtatataatatatttattttatatatatattatttatatatataaaataaatatattatatataaaataaatatattatatataaaatatgttttatatatatttatcatgtacagaatatatattatatgcccatatatatatatatatatatatataaaacttcccatgccaaaaacacaactcttcatcacattattctttttctgatagcgtagataaagggagactgagataaaatatcctagtaggaaacctcagaaagaaaactattcacaatattcaatgggagtttagttggacatagaaataaatattcagaagaaatcaagtttacgacctggtaagaagacttgccatttgtctggtgattcacagttttggaaagtgcttgcacatttggtcctaaaaaaaaaaatcccctagaaggtatttgggacagatattatttccattttttttttttttttgagatggagtttcgctcttgttgtccaggctggagtgcagtggcgtgatcttggcttactgcaacctctgcctcccgggttcaagcgattctcctgcctcagcctcccgcgtagctgggattacaggcatgcgccactacgcctggctaattttttgtatttttagtagagacagggttttatgttgggcaggctggtctcaaactcctgacgtcaggtgatccgtccaccttggcctcccaaagtgctaggattacaggcgtgagccaccgcactcggctgatattatttccattttatagattaggaaatcaagagtcagagaggctccatgatgtctgcaagggcacacagctagtaagaactttttctattttcatcttgaaggctctgtgattggaggctttgtaggatttttcttttacatttttttcttatgtgcttttttttttgaagcttataaccatctgcaagaaacaatcaccagagtaactttttttttttttttgaatcggagtctcgctctgtctcccaggctggagtgcagtggcgcgatcttggctcactgcaagccctgcctcctgggttcacgccattctcctgcctcagcctcccgagtagctgggaccacagcacccaccaccacgcccggctaatttttttttttgtatttttagtagagacggggtttcaccgtattagccaggatggtctcaatcagctgaccttgtgatctgctcacctcggcctcccaaagtgctgggattacaggcgtgagccactgcaccgggcccagagtaacttttgaccctaaatgaagctgggtctaccaggaaccaacatttaaaaatacctatacacaaaggtacatcattgtttccttcacaaaaattatatataatatacgtatatatagacacacacacacagttaagaaatgactgcccacacctgtttctactggtttagccccgataaaagtgtttctttgctatcaaatagacacaggtattgagccgaccaggatgaggaaagggtgtaccagcttccttcgagagaaaggtgtgtacataagagtgaaagaagaaaggggtctctaaacatatttgaaaaattgaccaagagagagctgtggagggaggaagctgagaacaatgtggggaaaggaaaggacacatcaaccacactggttgaggagtatgctgtctgacacagtacagcgttatgtttctgacagtgttaacttttgttttttgaaagttaagtttaaaattggtcctgatttttgctgctgggagtctgatggtagaggtagagtgaggtgttcccctcattatttcatttcttaatcttcctgcaggaggaaattgctctggttgtgttcactgcctttgaacctgtcgtgtttaagcaggctagtgtattttttttctcccaaatagtatacctcgtcagccagtcctatttactttgatttcactgcattttccagaatcctaatgaggtgtggcctagtggtgtgagcgcaggacctggcaggaagactctcaaattctagttgcagatgctagatgcttctatgtagtagagggcaagtctcttgacctcttctgtaatgccgttaacagggttaataatatttatttagctcataaaggcagcagggggattaaatagttaatgttgtttaaaaggctttgagaaaaagaaaaggcaagtttttttgtattgtgtgcattttcaaatgctaattcttattaacaggaagcatctgctccattacggtcattcagcacctcatgaaagtcttgctggctggatgggaaggaaaattcttcaattttgtgccatgagatctgagaaaatgtagctaccttcagccccagttatgaacttggatgtctgttttctccctatctaaaaacattcttcttctttatgtggtttttctaaggtttagtagtttttctctcttttgcaatcttttatgcttaccattactggtgcaaaatgactattgtgtttcagctgtggggggaatgaaccctttttataataggcagttagacattctggaagtctttgtgataaaagatttcatagaaatacaaggtgcttcagtaattgttctgttggtgccttgcataactgcattacagatttctaatactctggcagtttcaagatgctgatgatattagccactttgtgaagggtaattatggctttctatgcatggttgccagcactctcatgtcagattatagtagccttttggttaatctctattttaaatcagatcaaattctaacccaccctcatccctcctcatcccccttcccaaataaaatgagaagcactgtgaggatttgggagaaggacaggtggggtattttagagaatgagaaaacatttctattattattttttgagtcatcttcttattgcttgtcagttatggtttatgaagtgatgccaaagtataaggtctatcttgcctccaacgctgatttgctgcaatgcttgtttaagttgctagaaactggaggctcctgtgggtttccttctgtgcctaataatttcaacagagccaaatgccctttatttactacagtcataattagagggctgccagtgttaagcaaccatggaatctgagtttgagaaatgtttattgtgcctcattaaatctgaaatgagtacttaaaggtcagaaataaataatctgtttatattttttgtgacagtaaatataagtgaatgctgtgtgtacatatccttgactctactcatttcagtgtactgagacacccctctgtttgccaaggcagtaatcacaatatctgcgacaaaagagaactatggcaggtttcattgatcacaaacaagaaaatgatctattgtattgtatctaattagaaaacatcaatattagaagctaatgcattcactgtttccaagatggtctatcacttgattgttttttgtcagcatgatcacattttacgggcttgagcaacaagctggtacaagggaaatgaatttagaatgatatgccaaaggctgttgctccttcagtcttaaataagcttgtagaggcaactgggtttttagtggcacataatataaataatgggattggggttggaacagaatttgggggtgttgttttggcccaaaggcacaaggccacccaccgctttctctctaaatattttgaaagtcttttcagctgacaaagcttactcaatagaaattgtactctgcacactccgcaggcagtcagggctctgtagctggtaagtggcagagaactgaggcactgatataatagaatttagcagaaaggaatggaccagctcaggttctgagggtgctagtccttctgtgagccagaagggctcaaaggtaggctggatccaggagagctcatactgtgggtttctggatcccattgcttgtgggagattacacagacacacacacacacacatacacacacacacacacactcttatatgtgtgtacatatatgtatatatattatgtatatgtatatatgtgtatatttatttctttattagagatgggctctcgctatgttgcccaggctggtcttgaactcctggccttaagcgatcctcccacctcagtcttccaagtcattggggttacaggcatgagccacaatgcccaaccctcttgtgggagatcttatatgggtttcttattgtcagtttgaccagctttaccaaatcatagcttctaaaattgaaaccaccatcatgactattaatcttacatcttaggtcaccttctaacaatggttgccattgcctctaaagggcaaccaaaatggtcaccaaggtttcagggaacaaagtggctcatttctggatcccttgggctctgtgagtaggccctccagctaggtctggagaatgatttccagttagtgtgtgccaagtttttcctttgtctaactgctggactatagtcccctgactctttcattggaattagccaaggaaatcactcagagaaacataggtaggaagcaggctaatcacttccctgatgttactgttttctgattgcttcctatcccagtagcagaaaatgccaaaaacggtgctcctggggtttctcttattgtccttgttgcggcatgctctagctgagttagtacttaatgtggctgtagcacttaacgtgtgtgtttgttttcatggctctttaaaggggaaataacagttggcacttgcttgtaaagtgctttgatatttggggatgaaaggcactctgtgcctgcaaaatagctttaatgtgttgtagttacatgtttggtagggcgattggactccagaatttgttccactggcaaatgtggttgagagctatttggttctccattaagttctgtttacatgggattaaatagtttgacttacatgactgaatttttcattttatttgctcttgaggtactcttactcatactgagatattgttgattctgcatttgtacatataataggcattaactggttccagagagctttctataagcagatactatttcagagtgcactatgccccacaaaggacttagaaaagggtcgagggccttattcagaagcctgtatttgttttatggcatggtgtttaagctcgtctttcagcaggctttgaattgtatggtttactgcagacagctgctaggtttctcaaggaggcctctgtagtgaaattcacaactgggttgctcttctaaaggcataactttgacccaaagatgagagcaaagaaaagtgctttccctaagccatctttgccacctctaggtagggtgaccacatcaatggtgccagtgaaacaataggaatgacgatgagaggctgctaggaggggaattctttcaatttaatttgttgaatgttaaccacatggcctgtgtttctcattgatagtcctgtcctgacagtcactgggatgctagagttgtttaccacctgtagaaaagtagctgccacactgtccgtctgtgactcagaggtctacattctggtgaaccctcgtcttctcacagaaacgctatcaaattgggttcaggaacactatcatatgttgtcaccaccattcccagagatgtggcaggactgatggagttagatgggcagaaggcacctaactgtgtcatcttatccctttcagttatatataggctattgtgtatttataaggtagtagttgggagtgataacagtgaacaaattgtaactacagaaggcagtgtgcagagtggatgctttctgaagaagtagaaccaccttggcctaataaacttcgtcacctgccttaattgtgataagtagcctcattcttaatcccttccatctcttctctgatcattcattgatgcattatatgaacgcatgctaaatgtttagcgttgtggcagatggcacagggacctcaaaagagagcttccagtcccgttgagggatgaactgacacactacacatgaaataatcatagaacctgaggaaatgcataattacattgtacagtctgtatacaaagtgctgagaaaatgctaaggaacgtgggatgatcagtgatggagatatattagaaatgagggaaattagatggcttgtgttggatgactgcttagctaaggacttcatgtagatttaatgttaattgcaacaaggagctactgtaaggtcttgaaaagagaagtgatgtgatgaaaatagtgggtgaggaagattttccaaacagcattttgcagaatgaggtagaacaaatgcaggtgagaaaaaaatgacacaaggtgatgaaggctgtggaaatggagccaaaaggacagataatatgggctatttctaagaacgttatgaattgtataacctatttgataggatagggagatttcttgccttttatgatgggggttatgtacatatgacacatatgagggccaaattctcccatgtgagtcacctacagccattgagccattagggtgttatttagttctacaaagtagcagtgtaattctccaagttgcagtccagtagcctgcgtacaagtatatgcctgtatctgcaggtacataggtgccagtctgtgtatgtgtatttacctgaatgtctgacattttgatcatctctggtaaaagatccattagtttgtgagctccttgaaggtgcaggctatttttttttaattcccagggtttggttcatgcttactggatagataaatgaataaattaagaatcactttgttttagaagcctagaattgtggagcttgaaggcaacatggagtccttttggttattctcctcattttaaagaaagataaattaaggcctcaagagggttaatgtgattcatccaaggtcatctgtaagttaatgacaatcctagggagagaatccagctgtccccactataccacattgctttctgtagtcaaactgtgtgtgtttgtgtgtgtgcgtgtgagtgtgtgtgtgtgagagagagagagagaatgaattagggctggggtgtgtggggagcatacaactgacaataagtggttagtaggagtttacctagcacgttttctagttcagggcaaatatgaactttgtaatgttggcagctggggatggtgccttttattccaccttcactaattcctgcttcagttgctgctgtctggatggatgagtctttgaatatacattctagctggaggcacgtcagctttatttttatacagaatttgcatattcatttttatgtgttgggggtaggaagtaggcaaaaactatttattatctcatttccaaaagccatctttgtgaggagatgaccatttgaacatctaaaacagcaaccagctttaggaaaggttatgtgtcttttcattatggatcaataggcacaattatcattattggaagtcagcagttaaaaaaagaagcagcgttttataatcactttgttgtgtatctgatacgggattccagttttcctgttttgattgctaaaatgacttaagagttaaaaactttaaaaaattaggtagcaaattatagttataatgcttttcagctcgatgggactttaaaagtgtaacttaaaagttcgttcattttcaaatgaaaatctaaagatttgagtaacctcagttttaatcccaatgtctgcaaccttttttttttttgcttggtatagtgacctgggatttgtgccactggacaaagagtctagtcctggatatctgcatttattgggcttccttctccttaggtttgaagtctctctgctgataaatgtggtgctgagagagctgcagtcactcttctagagactagggcacgattcagtgaactgtaaaagtaatgcaaaatgacaattaaagtagggcattctctggtaccttgggggcctgacaaagtggaagtatttgacttctgatatgccagacttactaacgtagaaatgtaataacatatcccccacccaaacgtcttactagaatcctcctatatccagaagggacctgagaacagcaagtagtaagcaaagaaagctcccaagcagctaacaaacaaacacagaaacaaacaacgaaaatcaaaacattgcacaaaggtccctatattaaagatcatgtgatttcccccttaggagcgcaacatctcagctgtctatgcagaacgttacaactcttttttttctagacacaaatataattgtatagtttccaagaacacagtagagtaaaagcatcaaacttgaaatggaagaaaagctacttttgatataccaacagcactgaaaagttaaaaacgctgtgtttgatagaaggttggtgacgatcctatgttaaaaattaaagacaagaaaaaaaccacagcagtttggggtccttgagtatacaggcaaaatctgcatggggtaataatttacatttataaagatgctcctaagtaaccaataagtggttaaattatgttttttataccctattttaaggagggcaactttgtgatatgtttcagaaacaaggcagatggttaggattttaaatcaaagttttggttcttaaaggataacaccctaagctatctggaaaactgagctgtctagaattatttattgtttgagaatttttaaaaatcaacattttattaaacctaggtcatgtgagacacctgctttcagtgttatacccaaggataaagaattcgaattagaaaaagaatttgtgataaatatactaaataataagaaagtgactcttatttaccactgagatgaaataaaaaagtttgctctagacccatttttttttaatgtgacaattaggtttttccaaagcaaatgttgttcttatctctttgctgtgttcttgtgttaacctggctgtctgattagaaatggggacatttcctagtgaaattaatgtgacatttagagaaaatttcctctctcaaatgtttcatgttgtttgccatttagcatacttagagaaggtattggaataatgtcaagcaaattttgattaaataaggctaactaggagccaatacattcatgcaaaaaaaaaagctcttgtattattttaaagaatgtatttcttctgtggttctttatcccatattgagatgaccttggcaggtaatctgacaaaagaaatgacatcttctaaacagctgggcttgctttagaaaatgcagcacattaggtcagagcctgtggccagtcctttgctcaagacagttacttgccaccccggaggtacactaaaatttcctggaaagctttttaaaaaaatcacccagtgcctgggtccaattccaggctaattacctcagaatctcttggagtgggtccttggtgacagtatttttatttttatgttttacaagaagaagattctgagatgattctcatgtgtagttagggctgagaaccactggcttaagacatacaaactattcattaagaaaatatttccttcttcaggatgatctgatgatctgagtctcatcctttgctccaccagaagtgtgaaaaaatatactctctcagtgcacaggagttgggtttgggcatacaccttgaaccagtatgagctagaacacttgatgtcagtatacatagacccataatataatagcccatctatggccagttaactcagttgtttggaatgtagtactaatgaggccagaatagtgtattctatccaattagaataattctgctgcatagatttttcccataactgtaacccaactgcctcacaaagagacctgagacggattacaaaggcacaggacaatgggtgaatcagcatagccccatccattctgggaaaatcggttctaggaacctgccacattgactagcgctactaattgcattaggatgcagcatgagacatctgcccatgatggtttgtgctgatttgggggaatgatatattttcatttgaaggtcaggacccacaagaatgggtggtttattccttttggagttaaaaaaggaggataaaagataggaaggttacaagcttctatgatattcttctctttacagtagcagatcatgcctggcacatctgcctggggttaactgacctgtatttgggggaagaattgttaaggtaattactaacaagccctcgagacttgtctcttctcaactcagtgcctgggagtgggaatcctcatgatgagatatattatggcttaggaccaagaagtagtattttcattagtgatacaatgtgcatggtattgcttctttgcctgaacacgtggctctggcaccatgcctggaggtcaggtctccgcggagcttcatatttgatgcagagtgcacacaggttccatgccttcatttgcaaagatatggaaaattttctacttgagaactgtcttctttaaaggcagtaaagacagattctttaaatacagtagcttgggttgctgcttatccttttcctgcaaagccagtatcctctagatttcctttttgtatttttgtctctttaccaatcttcttgaaaaaatgatttagtttgaaagatgagatggaacatgcatgtgccactattttattgcctgaatgaggtcaaattcctgatcctacttggagttagttgcaggttctgtataaagcaggggatcaggattcccaccattcctgtcatgggtctgataaatgcagctgaaattctcctttggattcatgttctattatccctattttacagagagggaaactgaggcatgcaaggattaagtaatttgcccaagatcgcagagtgaaatgaatatttgaactgctgagtgcttaatcaattccgggttttaacagatgtattagtccattcttacattgccctaaagaaatacctaagactgggtaatttcataaagaaaagtggtttaattggcccgtggtcctgcagactgcacaggaggcatgatgctgacatctgcttagcttctggggaggcctaaggaaacttacaatcatggtggaaggttaagggggagtaggcacatcacatggccggagcagcaagagagagagagatggggaggaaggactacacacttttaaataaccagatgtgataagaactcattcactatcgagagaacagtaccaagagggatggtgctaaaccattcatgagaaaccgccaccatgatcaaatcacttcccaccaagccctacctccaacattggggattataattcaacatgagatttgggtggggacacaggtccaaaccacatcaacagggtagcataatttttgtggggtagtgaacttcccacttgttaaattatatattgtactgaatatcgtagatgaacacatttaaccaacatcatttttacctgttatgttggtacaacgaattaactcaaagagtgtttgttggttgactgactgttggataaacttcttccagcaaatacttggattgtattcctaacacagcttccaagtttgcctcctattcctgtttgtgacaatttcagcattcactctctatgaagaaaccagaaatgaactgacccttttgatttttaatcccccaacccatgcttccaatagcattaaaaattgcttgagtttacattaaaaaggagatataaacttctagataaaagcagtgtgagtagatattacacagtgcatcttcaaatgaggggcatgggtgggcacatgaacatacctgagtaagtgcagggcaatgttggggtttagtttccttttaagtactgtctcctcctctctctcacacattcaccgtcccccttcctacctattgtaggcacttggggtctgtattctgactgctggctgtttggtgcccatgtggtagctggatctgctattgcctgttctgttttcttctccatcaaactgtgagctccttggaagcaagggctgcatctaggagcctagtacagttagtatctgacaggtagaggtctgagaggaatctgctcttttgtttgctagacagaaattgtgtttccttttccaaacactcccagttgaagtaatttcagaaggctcctaaggaatggtgggaacagtggagatttctagtgggatggcaagagggtgggggagatgtgtttgggtagtttctagatcatacaatggttcaagaagagtggtactttagtgctgggggcgagatccactttactaggacattcagttactttagtgtcgacttttctctggatttcacccttctaaggcttttcccctctagttctcccaacctctgggtgatcattagctgtttttccatctctttcatctggcaggtattctgcatttgcttttataaagccattgctccagcagtctgctgtaaccagattaaacaggggtgctctaatgataggagctgagacaggggtttgcttgcaaacttcatgtttcacatgaaaggctttggcaccccctgtggactgcccttcaccctgttttaggcatagtatttgtttgcttttgtatctgtgataaaacaaaggccttcctgcataaccagtgctgagcaaatgtcttgaaacaaagggaagtgcagagtttaaatccacagtggtgtattaccttgcctgcatttccatatctttggaataaatattttaacatgttaattatctactactaataaaaatacctttgaacttccagtcaatttgatgggccatagaattgtctccactggggaatgggaagtaattagtttctgtaaggattgtaggtcacgttgtctcttctcagtaagtggttgcatggtcagtagccagtcatattctagggaatgtttgtgccaaggccgccctggtctgcagcggggagctgctgcctccacggagcccctagggcctgaaggaggcagaggctgctgctgcactgtggccttgggttccaattcactcactgcttcttgacccagaagaaaaattccttctaagtagggcagttcgaaatctacttatgaatcatctgtgtaacctttttaattttttcttctcattgcagactgaaaactattcttttgactccaactacgtgaatagccgagcccatttaatcaagaggtatgttggtttgcttgcttattgctgcaactaagcttgatttaacattaaaaagcaaaacagattaaaatttttaaaacgtatttttttgggggattttaaaatgaatgtccaacctactatttgtagaaagtttggaaaattgagaaaagcataaaaaagtaaataaacatcactggtaatttcatcaaccaaaggtaatcactgttgacattttacatttcttggtatgaaaatgtacgtataaacactcaacaataaaattggaattatattaaaatatagttttatctagtgacagaaatctgatattacaaatattcactatttctaatatttctaatttctaatattatttctaatatttctaatgtgatattagaaatatacaatagaaaactttcacaatcatgttgataccaaaattcttgttgctcttcactttaaataaaggaaagccttaaaaatgtttttcatgtagaacttcccatgagttttgagattgatgctatttcaacaactttgaaatcattttaaagatattttaatgacagagaagccaatcctttcctttctagatgagagagaaaaagaaatttgcctgattcttcttaaaatttttagaagtgtttcagaggaaacattcaaagttgagatttatgtgattggttgatcataatttagtatccaaggagccataatggatgtgagtacagagctgaatcctgccaagaaagatcccatctggtgcagtgggctgcacccaatgggagaaggacaaggggtttgggaagccctctaaaaggtggaaactgagcaaagaagagaacctcttgcacagaaagaccagtcctaacctttcaaatgatgcctgtattgctgtttcatgtaaatatcacttaaatggtccagtggttattctgcagctaaaattgaactctgagtatgtttgttaaaataatagaaatgaaacagagaggccagcagggtatgttagagctgtagcagagaaggcttgcaaattgtattattttgctggctctaatcccataaatttacatcaccagaagagtagaattcaaggaataaacaagcttcaagtaacttgcattcatgtctgatttaattcatgaggcttcagtaacccctaaaacatgctaagtttatctgtattggtctggaattgcttgtgaccttaagtgatgatcattagttgtctgaaaatgggtagcccttgtattatcagtgaaagcacagttgagaattttttttgaggggttgggaggaatccatttagaatattttcctgggtcacagaataaaagcaagaggtgaggaattcaaaattatctgacgaatttgttttagaaagaaaaaaataaccctcttatgtgcactgattagagtgcctttgtagcagaaatctgctttgtttctgcttccgaattgttattttcaaagctccattttaaaactttgataaaaacagtgacttgccttaccctcacaggtccctcgggctaactcagggtacctgggaattctatagccaggttaaacagataacatgatgctgggcgcagtggctcatgcctgtaatcctggtgctttgggaagctgatggtggagaactgcttgaggccaggagttggagaccagcctgggcaaaatagtgcaacccctcccccccaccccccaccatctctaccaaaaagaaaaataaataaataaaataaaaaaacctgatagtatgagtctgattgtcacagcctggaagaaagctaagactcccagggacccttgcatcttacatcagtcctgactatccaatttacaaggtagactgatagataaaaacttatgtttgaacatttatctttggggatacatgtatttccacagcagcgttgagacttactgggaacctctgattttggttaattactttatatgttttttgtttatagacacatacacacaaaaggcacaacctagacttaatgggctcttggtgaaaaagtctcctgattttgcatgaaatcaaagatagctttttcttcttttttttaaataaaaccagggaccaccttgatgaagaggaaacatctgaaaactcagggacacatgcatttttgccagggttctgtttacagagccatgagagctttgggaaactctgaaggccttgaatttgtgtggtcaattgagtttagatgaagcataatacctagaaaaatacagggaatcttgtgtgctatgctgttctggggaccaactgtgttaaatgtaaaatgtgtggaaaatgttgagagtggtggctaacaccaggtgataaagtcatgcgaagcctgttcaaatagctcacaacagtgtttgaaaagggttttgctgtatgtggtttcttgaagatccatttacatgcatggtaaacgctcttggccaggaaattctgaatctgattatcagttttaattttactatcaagtccctgtttctttgaatgccaatacaatacaatttcaggctaactttgagaacttctttttctttctttctttctttttttttttttttttttttgagacggaatcttgctctgtcacctaggctggagtgcagtggtgtgatcttggctcactgcaacctccacctcccgggttcaagtgattttcctgccttagcctcctgagtagctgggattacaggcatgcgccaccgtgcctggctaattttttttttatttttagtagagatggggtttcgccatgttagccaggctggtcttgaactcctgacctcaaatgatccacccaccttggcctcccaaagtgctgagattacaggtgtgagccaccgtgcctggctgagaacttatttttctatccatgttctcttcttctattcactttctacttatccaaggatgtttcttggacccttcttttcggcattctctagcagttgttagcattcttagccagactgtttacatacaggcatcttttcctcttttacatctatctaccttgagtagttgaacagcagctaccactgtccacctctggttctttccttcatcagtcagggttcctacatgaaatagttggcacgcctaaattggaatggcttgaggaaagtttatttacaaagaggaccatttacaaaggcttgggcacggttagtgaacctcaagggatactgcagtattatggcactggaggagctaaaaatacttcagacaggaccagggaagagagcatgtagggaacattgacttgagagtaacagtgacttctggttggccaagggatccagtcatcatgaagtgaccctggaggaagggagcagagacaatcaatatcctgatatcactgtcctcccctgctctgatctcccgctgatgtcttcctttggctaaacccaacagaaagccagagggcaagggggttctcataggcacaaatcaaggttgagaaggatctcaactgtgggaaaaggaagtgatatggcaggctccccataattttatgcaccaaggaatctagcattatatttctgtagttttttttttttccagactgtcacttgcaacccgcaggtgtacccaaggaggcttatgtgagggccccagattaacaaatcatggcagtgcagagtttcttctgaatggacttccttcctgctctgtttgtttcttgctgtcttctcagagcaaggaaagccagcagtggtactttgtcgctgctgcagcactctttcctcatgcctgttttgtgggctgctgtctgatatccactcctacagtgctttgggaacaatatcaagcagggcataaggctgtggcccaaagaaaatgaaataggaaatgaacaaagcactgactcagcgtggaaaggattaggagctttggctccctaaatcatgcacaatgctttctttttccacccaaattgtcctggggtttttccagcacttcgtatggtgccttgtatataataaatgcttggtacatgtttattgaatgaatgcatgagagaaatggaagaaaatcttagcatttttctattaaagactagcactagatttctctttaagccagtgatttctggattttaatgtgcattggaaacacctggaaggcttgttaaacgcaggtatgctagctccatccctagagaacctccagttgtaacaggttcccaaggtgattgtgatacaggtggtccagaaaccactctaggattttccttgtattacttaaatacagttataataatcttcattctcactccttgctcattcttagcctcagatatcattccctgggtatgtagtatcacctactagtaagatataacctgtttccattctgagtcttatgtcttttggaaaagagttctaatatttcagatggtaaatatgggtcagaatttgtgtgatgttcattcgtcatgcatctgctgagtaactcttctgtgcagaaccctgttctaggtgttttcaaacatatctgtctttttgttggccaccagagcagtaatagaaacatgggcatttacaataccattggaaacaggaacccctaatttattgtcccacaaaagttgttttacaagtccttcatctcccaagaggtatgcaggtaataaagcaagtgaaatcagcatttttatgcctggcataaattgttatttgttttgggtgagtagccatttaccaggctattttacaatatgtggcatcttgctcactgggtcttaaactgccttacacaaatccattcattaaaccactaaatgctcttacaagatcagtgtaagtggtgcttagtttgtcagatgggcaaactaatctttaaatgagttaactattccaaggtttgggggagttgttataccttgctttttgttctgagaatacacaacttctcgtgctcacactaccagtcccttacatcctagtagctaatccttcactgttttattatttccataatttctattcaaaaagcaaaatctctgaggttgtttgtaacattcagatgcctatgaaaaagatgatcaattttttaaaaggcagatccaaaaccaattaggagaagtaaggtagacatccctggcatccagggaggtaactgactgcaattaaacattacatttatgttgaagtttttgagaagtgaagacaaagcagtaagtacaccaagtgatatagttttaattattcattaaaggaaggatggccatttgacaggagaactattattttctgttctttaatgttagaagaaattaacacacacacacataatagtgtgtgactattgtttacagaagatatagaagtgttctttaaatataaattttctgtaccaatcctataaaaactatggacataatatttaattgtaactcagtgaaaacattactacacagaataatgatggtattaaacaataaccatttatggagcatctatgtgtatctggtacttcatgtacagagtctctttgagtcttctaaatggccttgtgaagggggttttagcaaacacattttacagataaagaaactgagattcaaagacatcagatatcaggtccagggtcacacagatgaagtggcagattatagattattacttgtcctaatgactccaagttcagtgctctttactacagtctgctatagaaataaagaacctagagcagttgttctcaactgtggggtgatttggcaatgtctctttggagacacttttggtttttttcctttaagtgggggtcactactggcatccagtagataaagggcagggatgttgctaaacaccttataatgcacaggacggccacaacaaaggattttgtagccccaaatgtcaatattgccaaggttgggaagccctgctccaagggctggttaattacattgcccccatactagatccctcaccatcatatgtttcaagcaagtttcaacagctgctgaattcagagttgaattctctggcttaaagtgacaactttgtgttgtggattaaggacattttcagataccagaaaatatacaggttggaaagttaagtatttgttataaaaatggacctgaatatcatccaggcaggtcatttcctttctccagaggtacaggggtgcttgtaggcaggcactcacctcacgtgacagagaataatttctaaaaaacaaactttacatctatttaaactgtgggattataatagtatttacagaaaactccgtaatatgtgccataaagctagaaatggtgaaacactttaaatcatgtgtttccaattggccatcatggccataaaagaactgtaagataatttgcttgtttgtttgttttttaaagaacggcatcctggtgggtccataaggctgagttagctgtgtgacataaattgaaggagctgagtgagctggcctattgagtaattttaattttagtgcagttgatgctcagttattctttctgaaaataattagctaacaggtcaatgcttcactctctcctgctcttcattttcttataattatggctttccagttactggcctcctggtctttcctttttatattcaggtcagcaagcattctacatctaggttggtcatatgttaaaaatctgctgtgattcttcttgactaagtgtggagggtgacaatgtatccattgtgtccatggcatagctcttcattatatgtgctgaatcttcttatcagtctcagagagccaggcctgtgaatgtccaaggttgagcagatcaagtgagtttgcggtgtcatttccacagggctcttttctcagaggcataggtctattagggtttgtgttaattcacaaacatgccattcttccttgttgaggcaacaacacattttcttgagtgtgcctttgctgcttcctcaccgactagggaatggattcaccatctactaggtatttcagatgcataatttatggttcatggtgtagcaaagctggggattctgtcaggacatacaaagtattagaaatagtaggtgggtgccctatagctgtaccttatgcattattctccatttcatgagaaatggtgtgaagttcttggattgcatgcatagtgcattgtatggtagattgatttaataaatgcaagaatcattttacctatcaacacttgagctgaaagttttcatgttcttagtataactatactcagagttgcattagtgctcactctctggctctcacttttgtcttgccttctatattagtcagggttctgcagagaaacagaaccaataggcatatctaaatctataaatatgtagaaagagttttattgtaaggtatgggcttatgtgattatgggggctgaggaatctcataatctgccatctgcaaggtggagaaccagggaagatggaagtgtagtttgaaggcctgagaaccagagagccaatagtgtagattcaagtctgggtttgaagtcttgagaaccaggagcgctgaaggcgggagatgattaatgtcccagttcaagcagtaaggcagagaacaaactcaacttctttcttaatttttgttttattcagtccttcaatggattggatgatgcccacccacattggagagaattgtctgttttactgagtctgccagttcaaatgctaatttcttctggaaacaccttcatagacacacccagaaataatgtttaaccagctatctgggcattccatggtgcagtcaagttgactcacaaaattaaacatcacaccttccacgctcagctactgactctcctctttttctttgaatatgttcatctatttttctcagataaaactgacttactgggttctctgatcctgataatccttcctattttagttgcactacttcaatttctgctacctttgctttttacagttggttagtagacatcttttaagaatcagtgtacatagtggttaaatttctaggcaggctctggagctagactacctgttttcagtcttaggtctgctatattttttaccagctgtgtgaccttgggcgagttatctcacttccatgtacctctgttttttttcatctgcaaatgagaatattagtagcacctttctcttacagagttgtgatgatttcaacagttaattaatgtcaaacacttaaaacagtgcctcacgaatagtaattgctcagtaaacactagctattattattttactttgattttataggaagagaaaagtcttctgaaatgatgacattctttagaggcagttttagaattgtagcttcttccaccttgtctgtagtgatgcattgaagataagtgaacgaaaatattagctgtatcagcatccaatagtgggaacctctgtgcaatgttaagttttattatctttaagcacaaatttctcttccccttattcctaccctattggacagtctagccactgtttgcctcattacagagccgacatcatcctggctcagaaagatttttaaaatcagatctgtcacggtcgtaaattatcattctgtcttcaacccagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatggtaaggactggttggatgtaagttgcagcaatcgactccaaagaacccaaaatgtttgtaggcacactatactactttgcttaatgagtgtattatcaaggtgtctacagagctcacacctcagcagcatctacaggtttttgagatgtcctgacacctagccagattcttctttgccctccctaagtggatcccctaggtctgtataaagttcaggcactttagaagctgactacatgtgcatattacatacattttcttcaataaaactgcactgagctcataggagatgaacagatgccttctctccaggaataaatgcctatttttgctttagtacatgaattcagctgatcaatcgaattgcatagaacacagcactaatgagaccaaaggggtgggttttatttccctatcagactggttagctttacccagagtgagactctgttctctcattacagattgtgtactatttactgaggatagaaaataccaaacttcccattttgtctatggggctgctatgccaaatccctccctctagcttccacacaaaaccatgccattagtcataggggagaccagggtaagagaacgtggctgagtcaatgtaaaatattccgttaatgtgaaaggcacctcaaagcacatgtcaggagtggcatcctcatgtatgaagaagagtctatttctgtgaactcggaactcagccacacatgctttatcgagaggcactatttaaaactttgctaggcagaagccagggtataaaaacattagcagagttcagctaaggcagaatgtttagatggacttgggcacaaatgtcattttcaatattttactgatgcaaacatgctatgcaaacagcctgtctttttcaattaagaaatatgaattcaacttggtggttaggctcagtgaagcttcagaatgcttggctatgtcttgagaaaagctagactcaagctcagctggaagccctactgctaaaagacttaaaaatgagaaaacaaaatatggtgattatgtgctggtcttcagctgtttcatttcactgtaaacatcattaaatgcttttgttttggtttttggaaataagtccaaaggaaaaaatgtactatccacaaaacaaaatgtttttcatggaaaaaaattagtcactgtagattctattaaattgtcttaatccattccctccccagcagacccaagtgtcaaagtctattatatagagaggtcactatgaattgtgcactgctgtcttccctaattggtgagtggtgacatctgcagagataatacactttctgggaaaccttactatgactaaagatgaaaaaaattaaacagttatataactgaaacagagacaatttaatactcagaggattagcagtatgtcacaggatgcaaactgatatatatcatttactagttgtgtgtttcaaagaaatgctttttcatttatatcaagaaagggttttagttagatgctctctaaaatgaaatgactccaggaaaggaaatagtcataattgattctcactttatgcctggctagaacaacatctgttttatttttttgtcacatttctctaggaaaacagtatcagggaactgcagctagttttttctgagagagtgtttcttacaaattggatgtattacatatatatgtgtgtgtgtatatatctatatatgtgtactgtgtagattggataataagacgagtattcttttttgtgaatgcatacctaaattttatttcagcttagtcatttgggttgaaggtagagaccaccagtctccatataggtagagtgaccacataacccagtttgccttgtatacctcactttacatctgtgtccttggcataatcaataatgagaatattctaaaggaaatgtgtggcaatactccaagattcccctacatataagatgatgattttacacacacacacatgcatacacacacatacacactttctgctgggccattttggcaacactttcacattttgtttcttactatttgatttgcatgtgtgtatcttcattttttctattattccggcagtggttaaaccttgagccaacccttgagtgagttcttttcaacttgtgtgattgcctaaagtttaggtacaaaaagaatttgggccttgtttatacctcagtctctcccttgtgatatcccactacttctgaagctttctgtaataatacttgtgtgtcccatagcaacttcaggcttgccacagattccatcaccagttcacttggactgatactgcaacctcaaaaaagagcaacaattccaacaattaacatttcatagcattttaatatctcaagtctgcatttgcataataagtatatcacattttatcttaaggtacagtggttgaaaggcagtcactgggtgatccaccatgcatgcctgatcttatagccattttagttagattgtcccagggtaacatggtattgttgcttcaaaggattaccaatttagaaaggtgagaagggaaaatagaatctgcactggactgagacctgtactgaaaatctcaagaattccttgaggagaaaaaaactagtccccaatccccttggttcattgacagtgtgatgggaatcttaaacccaagtgttctgaaattcttggagttccagagcaactgttcttgaggtttgggtaggtgtcactggagcagaatgaagaatgtagtgaatttgtcaggctaactctgatcctggtatttcttttagtcctgccagaaccactccaaagttgggccaaatgtatccaacaagagcgtaccttacacctttgttttggggagtttggctcaccttgtattccatgtctgtagttctctctgtgacttttctaatttggatattagtactgcatatttccttgcacgtatgtggacacatgattgaaggggaatctcagaatttcaaaataaagataattttgtgcatctgttagtttttcctttgagcaggaatggtttgttcaaggagctggtattgtgttgcctgtgtttggggtaaaggtataaactatatttgctcctctttttaagagatacctgggccctgtgcttttccacactgccaaaatttctatgggatttgtccttaagattttattgtagcagaagaatgatcggtgtgaatgacaagggtgctttgtgactctgagtaagggcccaaattccttaattttcagtaacccttctctgagaacattcctagaggtgggaacccagaatcactatatttaatgaaggaaggagaatgttatattcaataaaggaaggagaatatctagaagacttctttttttttttttttttttgagacagagtctcactctgtcacccaggctggagtgcactggtgcgatctctactcactgcaacttctgcctcctgggttcaagcgattctcctgccttagcttcccaagtagctgggactacagatgcgcactaccactcctggctaatttttgtatttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgccccgctaattttttgtatttttagtagagacggggtttcaccatgttgggcaggctggtctcgaactcctgacctaaagtgatccacctgccttggcctcccaaagtgctgggattacaggcgtgagccaccgcgcctggcctagaagacttttgaactcaaagggcaaaagtcaggtatttagtcactaggaagtttggattatgtgtttccttttcaatttttaaaaatgtctaaatttattttttattttgtttataattgacacatcataattttacatgtttgtggggtacaatgtgatgcttcaatacatgtatatgttatataataattaaatcggggtggttagtatatccagcaacctcaaacatttatcatttctttgcagtaatagcttttaagatcctcttttttagctatcttgaaatatacaatgcattgttataagctatagtcaccctactatgtatagacaccagaaggattgtgtttgattgtccaaccagacacattcgtgagctcagtgagggtggaaatgagagagaatgacaggaatctctgctttctggattactgtcaatcttggtatttctcttgacatgcctaagaccaggtcagttggttgatgaactggctaagctgaatttcctggttgccagctgactgaattacaaattgatttgttatccagtgcccatgaattaatacgtttcagtttgtccttagtattcagctcttgttatggcttcccagaaaagaagatgatagagaattctttatcctgtgctttctactggtgtattgtagaatggcaatttggaatgctgtctcttaatagctctgagtggcttgagaccaagtaagtgttgtcattggcgggttttaccacttgatttggttcttgaggcaatttggtgctgagcttgggagtcaacactcaaattttttaactgatgccttctgtccctgagggaattacttggcttgagggagtctgagttacctggtaaaattaccaccctttggtggggataagaattttgcctttatgcggttcctgcagagactctctaaaaagagtgattgacaagtagagtagtgagaggtgccagaggctcatgggtttgttgcgtgattaggggtatcatggggcttgaatttcttcctatccgggttatctctgagctaagtagtgggggctggggtctggctccttcttgcttctttgcataacaatttttgatgatgtggatatcccattattcttacttaaatatgtaatcctgatatgagattggggtttatagggatcatgccctagaagtgtacactagtcccaagctcagctattttgtttcaaattacactcagtccctctttccttatggttttaattattgattataaattcatcagatgaaaagatgactctaattgctctaatatgcacccaatttggagttcgctacaacactgaattggtttccctccatgctaactgataccaaatggaagcaacttacagaatttttttgtaagatttagctgcttttcatatccaaatgcgtccaaatgcaatataatgattgctttatttctggaagtatagattcttctgttttagtagacttgtttatttaccagtttcatcacctgaatagcatttaacatgtttgctgtgtataacatggatttgaagaacttgatctgtacctaatgcaactgctgttaacaaatttgccatgaaaatgttctgtaggctgcgtactatgcttattctagtgtcaaccacaggtatattaagatgtttacactttcaacactctaccaacaatatgtaattttgtttcctctagccatttaaagaaattatgattccatgactgaacatccttcttttatcttcttatctgtcccccgactcacctctctcctcactgaattttgaaacactcatttcaattagtctcttggcaaaatagggagttctcaatggagactattttgtgtcattgcaaagcagtgtgctgctgggctccagatatggtagcatgggccagatgttcatagagtaattgaaaattccattttatcagaatagcatttgctgtcaaaaagttttatctttacgtgaacaaagcggttgattagatccccctggacctgaattagcatctttgaggctagatacactgttttgcaattcatgtggttatttctttcccagttttgctcatatagagactttaaaaaatgtcttcatcctcttgcaaatatacctagtgaaatttaattacttgaacccaggaatgtgtatacagcgtttctatatatgtgatttccagctgctttcatcctgcctctggtatactaggcaggaataaaccatgaacagatatatatcactcattactcagtaatatttttgagtgcccactatgtgcctggctctgggaattgaatgtgtcaactactgctgttattgactgtaaaagttgttatctttttacttttattaatctggggtttactgaggtgaccaaggccagctcaatgatgaaatgaataattctattttaaaaaattataagaatagattttggggccattaaaaaccttgtgaatattgtgccagtaaagcaagagaagcaatatgaaaagactgttacaatcaagatcttattttcaatgggaatgtcatgaaatattcctcctttgatgttctaatttggacagtatcacattggtaaacatttttttttaaaatccacctgttgtgaggttgaatttcctactcatctttggttaatgtcattgtaggatgctaagtttaatctctgacatgtccaattaccttgctggtttagaggcagtcagtagcactcaatgcctagtacccctttttttctgatgcccagaaactttatcctttctctcagtctcagcagtttttgggcaggtaggaagagaggtgacaggtggagctttttcttttttttagttcaaaaccaattatctgctgtaccacataattggattttttccaaggcaacatttacattttattggaaaaataatcactaaaataaaaagttgttcttcactaatggaaacctccctgttgttagaatttctttgctagtattcttttggcatgggccctttggtcaaataattgttttaggacagttcaccattggtttcttcatgcaggacattaagaataatatcaaccgtttgtctaattttaaatagatacgctattgtgttatagcatatctatttaacatattgtgttatagcatattgtgtttcccaacatatatatatatatatacagacatatatatgtatatgtgtatatatatgtgtatatctatatgtatatatatcgggaaaacacatgcacacacacactatacacacacacacacacacacacgttggttatatatatgttatgcggttcctgcagagagtctctaaaaagagtgattgacaagtagagtggtcagaggtgccagaggctcatggatttgttgcatgattaggggtatcatggggcttgaatttcttcctgtctgggttatctctgagctgagtagtgggggccagggtctggctcctccttgcttctttgcataaccatttttgatgatgtggatatcccattattcttacttaaatatgtaatcctgatatgagattggggtttatgggaatcatgccctggaaatgtacactagtcccacattcctggattcaagtaattaaacttatatttgcaagagtatgaagacatttgtaaaagtctctatatgagcaaaactggggaagacataaccatatgaattgcaaaacagtatatctaacctcaaacatttatcatttctttgtggtaatagcttttaagatcctcttttttagctatcttgaaatatacaatacattgtttctttccatatgtatatttatgcttgctttcttactctctgtatatgtagtgtgtgtgtgtgcatgtgtgttttcccaatctacttggaacttttagttgtctgatattcaaggttattttaatatttattattactaataattacttgtggtgggctgggcatggtggctcatgcctgtaatcccagcactttgggatgctggagcaggtggatcatttgaggccaggagttcaagaccagccttgccaacatggtgaaaccctgtctctgctaaaaatacaaaaattagctgggcatggtggcacatgcctgtaagtccagctactcgggaggctgaagcacaagaatcacttgaacccatgaggcagaggttgcagtgagctgagattgtactactgcactccagcctgggtgacacagtgagactctgtcttaaaaaaaaaaaaaaaaaatgaagaggaaaaaaacaaacaaaaaacgaaaacaaaaacaacagaaaaaaaactacctgtggtaaggaattcattactcatcaaaaaataaatgccaaagcttttcttgattagttgacattaagaatttccatatttttaagcattttgaaagcattagaggatgcaggatatgtaaaaggagcacaatgaacaattaagaatttcattctccagtagtttatggcccaacagcaaaaatggtccagtatggaatagactacataggatcggtgaagaaagtaattaagatttttgagctggagaccaaaatgcatttaaaaggacactttggtgtaatgtgatctctttggaggaatggtggaagccaggccccaacatagtatgctagataaaattatgctctatttgggtgatttactaggtgaatgttttccagtagcttcatgaaaaatcaacttctataggccatgaaaagtagggacactgccaataagttaatagatgagagacaaatcaagttgttttgtgggactttccctttctttctttctttctttctttctttctttctttctttctttctttctttctttctttctttctctctctctcccttccttccttccttccttccttccttccttccttccttccttccttccttccttccttccctccctccttccttccttctttccttttttctctttctctctctcttttccccttcccttctcctccctcctttcttttcttttcttttttctttctttcttttctttttttgagatgggtctcactctgtcacccaggctggactgcagtggtgcgatcacagctcactgcagccttgacctcctgggctcaggcgaccctcccaccttaaccttctgagtagctgggaccataggtgcatgcttggctaatttattttggtagagacgggattttgctatgtttcccaggctggtctttagcccctaggctcaagcagcagtcctcctgctttggcctcccaaagtgctaagattacaggcatgagccaccgctcccagcctaacattatttctgtcctgtcataagatgattaagagccataaactcttatcaggatgggaaatgataaatctaaacatggattttaaatatttgtagagtatttttttctgtttattttcctcttaatccttttgttatgaaataaatatggggaattaagtccattcatagccagtttaagggattgataccaagcattttttttttttttttgagacggggttttgctccaggctggagtacaatggcacgatcttggctcactgcaacctccgcctcccgggttcaagctattctcctgcctcagtctcctgagtagctgggattacaggcctgtgccaccaagcccagctaatttttgtacttttagtagagacggggtttcaccacgttggccaggctggtctcgaactcctgacctcaggtgatccacccgccttggcctcccaaagttctgggattacaggtatgaaccaccgcccctggccccatagttttaaaagcaatttcaacaataccaaaattatgtatcatttatttattctgtggacaaaatagtcgtgagatggctttcctcttttatgatagatgctttttgtcatccagggtcaggacttgcccaaggtatttttggtctcttgtttttatcagatggctcagtgccctgtatactttgcatcaaggaaagcttaattgatacatccactttggaaacgtggctttttgacaagaaagcctttttaatttctctttctttatataaggcttatccccagtaaaactccagcctagaaaaatcattgtgttactccattctcacactgctataaagaaatgcccgagactgggtaatttataaaggaaagaggtttaattgactcacagttctgcatggctggggaggcctcaggaaacttacagtcgtggcagaaggggaagcaggtactttcttcacaaagtgacaggagagagagagaatgagggaatgagaaagtgctatactttaaaaccatcagctcctgtgagaactcactcaccatcatcagaacagcataggggaaaccgtccccatgatccaatcacctccctcccttaacaggtggggattacaggtccctccctcaacacatggggattacagtttgagatgagatttgggtggggtcacagagctaaaccatatcaatcatcaagcaccaaattagaaaaggtttgagctgctctttttaggaacatcagaaaagttgctttttaggggatcacacacaggttcttcttctgggcatattttcaaagatctgacataatctaggcttaggtcttagatggacttgtaaagctcacagtggatagataaaacagactcttttgcaactggacaaagtggaaccccatagaccaatcattctgccaggtagagagaatataaagcagttcctcatagtttgcgatgaagagattattaatgaaatatcagtctccagagctgttttggagcaaatcctttgggactgtaagtgtgtgtgtgcaggtgtcaatgtcagaagggtgctgtaggattttaggttttgtggtaaacactggacttcacttaacaatgtgccattcagagatctaatatgtggttggaagtatgtgtaggatggtgtgtaaaataggtaattcgaaaggcagtgaatctggaaggggccaaaagaattgatcagaaaatgaactctttgtgactgaagttactcaaagttttgtcacattgaggcggcctaatgacaaatacttttttcttttgagggtctctggtcatcagaaacaatagttgtacttcattatccttcatgacagtttagacaacaaaaatgcaagctattaaatttgaaataatagacaaccctgttttatcattagtttagttctttttaaccttagtaatactcattttaatggcaaataaggctctttaggttactgccttagtttaacaggaaaattttcaatctggctaaagaactctagagttttagaactctaaaagcaagtttatctccctctgcccccagtaagctaagccttagggcctttctaaattatggtctagtccctagactctaagtaatgcaggactgcaactgtaatctgctttgaataaaaatacaacttataatgttgctttctttttaagtagaaatctgtaaacatacagtactctaataatttggagaaacttgatactcttgcagcaaggcagcttccaagtcatgggtttgcaaatccaagtccaatgccagagatatattttccaatttctgtggtcgcttttccacctctaagctcatatattctctccttttctatccttaacttgcataataataaatgtttgacaacttgctttctttcctcctctttcagtctctatggagtttccaacctgtgtgaacaatagaatatttcccttttaatacatggaaaagaggaaaaagaggaatgatgtatgtttcgagatatttaggctggtcaaactgttccaaggcatcaccacctgctgtttttaatcattaatgaggctgtcagttgctctaatctgggaggtgaaccaaaagaattgttttgactttaatttaatttaaaaatcagcttattgaaaaaaaatgcttccagcttctatgagtcaggttgcacactgttgataaaacaaagcaagtcaaatgttgatgctgaaccatcattcatatgcaaacgtgaaccgttttaaatttgcagaactcttattattaccatcactagccagaaattttagttctttttttgtttgtttgttttaaacagcgtctccctgtgtcgcccaggctggagtgcagtggcgcgatctcagctcactgcaacctccgcctcctgggttcaagagattctcttccctcagcctcccaagtagctgggactacaggcgcctgccaccacgcccggctaatttttttttgtatttttagtagagacggggtttcgctatgttggccaggctggtcttgacctcctgacctcgtgatctgcccacctcggcctcccaaagtgctggaattacaggcgtgagccaccgcgcccggccaaattttagttcttttaattcaagtagtcattgtattctggagacatgctgcgtgtaaatatctgttccattttttagaagaaaaactgatgcaccaaaattttaaacactctattaatgtcagaacacaaatctatagcaaagtccagagtgaagcctaaagtgcaaattcttttgcttgactcaatgctcatcacactgtttgtatgttttagaagtttagtgactatctgtgagtactctattaagttggagttttcttcactggatggttttgcttagtgacaaaatgagaactcagaaatacagtgtctgtgcacaagtggattttaacgacctagagccagacctttgtttgtgccaactgtcaatttggaaggtttcattatgcctctctcagcttcatcaaacactttcagatttataattgatgtcaactgaagttgaagtcaaagaaaaccttctttttttgactgtagaaaatatcaccttattgttgggccctggttagccggagggtaggtgtatcaaatcacactagccttctgctaaaacagcaagtgagcacttgctgaattcagctgataatcaatctgcagctaatgagtctgcagacagactgagcggctggagctggcaccaggaaaccaccattccaactaaccatctcttattaaccttttggtgtttcctttgtgacgctaattagagacccataaaactatctgctctagatcttccgtttaaaatacaattttcaaagaaacacaattcactttaaggctcctgttagtatggccttttcaaacctcatgaaggaaaatgactgacttgccatttaagtaaagtttggataattaatctgtaatgttttggtaattaaaatgccaggaaaagttggttctgtagttggtataatttataatactctccagattccggtggtactgaagtaggcggcagatgtttctaccaccgttatgttttgactgtctgaaagtacccattcccacgctgtagccctgtctgccagactgcctgtctgcctcctcctttggtgtgaatttgttttgattgcctgagggggttagatgtgtgctttgcttcctttctgggggatgatgagccaaggaatgagctttgtactcttgggagagggaaaagtcttcgaagttgacatgctgtttagctcaaaatgagttatcaaatgggcccactcaacgttcaaactgttacatttgcatgatgaagatggaggagcaccatgccttcctgctctagtcccccatctcatttcctctttaatattttttacacccagaacaagagcattatgagataagtgttctaagcgtgttggacccatgtattcatcctgtgctttcgtttacctgtctacagcaccttttagtgcctcatttctctcatttgtttaaaataaaaaattacctagcataaatgacttacatgatcctaggggacagaatctctagatgaggaattgactgactattaaataagtgagatctgcaaagctggacattgttttatttgatttagcaaagaggtactcttcgagaagcccaatattaatcatctaggatcctttagagattaaaatatccataccagaaatgcaggcacagaacccaatattcttgcagcattacctggagcccctttggtatcttaagttttcattgtcatcaatatggaatgttcaaagtcctaaaaagtccctgaaatcattgtgatatggaactcatgttataatatatcatttatcccttacagcaacactgaaagggagagacaagcatagaattccaaatagtcaacagaggaatgacagccatctatagtgaggatcaaaatcagaatcttggctgatggggaaaggttcagaaaattagaatgaggtgataagagagaatgaaataagataaaaatatctatggttgaaaccgagattggcagggacaaaaggggtataatccagatttccttttatatgtactatctagctaatactcattgataaacctaagaattctaattctcattggagtcttccagacagatagtgtccaatcacttcaggctccaactaatatgagccagtcctaatgaatcagtacaactatttccactctactccattatattcaagattgacatcattagtctgcctgtaaatacaaaggcaggcagaacatcatagtggctaagagtacagactttgaaataatacagatttaagtttcatgcttatctttgccacttaatagctattgaccttatttgttcgaatcctcaattttcacaactgcaaaatgggagtaatgatagaaattacctatcagaatgttgtgagaagatccagataaatacttcctggaatatagcaagtgtccaaaacatagcaagtgttattgtggggactgagtcagtggaatagccactttataggatttcaggtaccctaccactcaaagcccctcatctgtttgcttctatctctgatccctttaacagaaaatgaggcatttcattttacagttactgttcacactttaagcagtccatggggagagaaaatgcatttatttaaattcacactaagttgtaaatagttgctattagattgtttctaagcttattatttgagaggagtggtggggggaagaggatcgtttctagaatattgaactttaaaagtctcagaggggagaatcagaggggagaaatgcatagaaatggggtgacaacctcatgagtttgccagagctattggtgtccaaagaaagtaatttgatttactcactgtgaaatgtctggatgctggaaagctgcctttactatcaaatcatttttctgaatcagcccagactttgagaaattataacatgtctgccaaaggtttgaaaagaggttgtgttcatttacattgcaaaatatacatattcttgagcacttactgtgaggtaagagaagccctggttcctctctggaggcattgactccactttgccctccctgtatcaaaagctgcataccccagccccaggatccctgctgctcttccctgctctccctctcttgcttcacggttcttaaatggctaatgggtggtagacgtcattttgattcctttattttctctcccactgcatgcccagactttcattaaaaaataaatgaggggatgcatttttcatttttagtttattttctaaaaaagccacactgcaaagaatcccttctattctttttttctaacaatggactgaaaaatgctcagctcctacctgaaaggtcatatctccttgccatatgaatgagcttccagcaggtccatagggagagtgtcatctgagaaatgatgggaatttatgtgcctttggattttggcctcattttgtagtggaaaaataaatttgttaatgatagaaaaaaaatctcaaccaaagccctttataaaattctctctctataactcccaggagggagcctctcagacacacagttgataaatgaaaaaatattttttacccttgccttgcttagagctgtttctcttatattaatgtaagccaggtggcccaccttcgctgataatatggtgttgaatatagcaacctgcagttctattgcataaagtattttggcttgtaagggaccttgtgacatgtttgtgtttgtcaacatcctattggaaagtagggcttggggagacatgtacacacatagaactgtgtggaattagggatatgaaaaaaacaacttataacacagaggcaagcactgtgtttttgaaaaaggcagattcattgtgaaaataaactttcttttatagtttgaacattccatgaacaatgtaactggaagtgcatactttttgccttccccaaaatctaaatccacgtgctatatacaaaatgctaagatcattatagtcctggccgggcgcggtggctcacgcctgtaatcccagcactttgggaggccaaggcaggtggatcacaaggtcaggagttcaagaccagcctggccaacatggtgaaaccccatctctactaaaaatacaaaaattagctgggattggtggcgcatgcctgtaatcccagctacttgggaggctgaggcaggagaattgcttgaacccaggaggtggaggttgcagtgagccgagacctcgccactgcactccagcctggcaacagagtgagactccgtctcaaaaaaaaaaaaaaaaaaagatcattatagtccctaacatactttaatgccatgacctactgggaaatgagaattgtagttttcattctattgtttgttcattgtagagccttggataagtcactaacctctcaaagtctcaattcgtatatttacaggtgggatgatgagcaatgttgcattaatgttgataagaccaataatcaaagtgtctatctgtctatctatctatctatctatctatctatctatctatctatctagtattttttcttagtacaatataattgtgaatcggatggctaggtgttttgccggtttttggtttttgtttttgtttttttgttcccttctcttccttggcctgttgacctgacctgagaattgggaactttatgtgctcatcatattccacagattcatagcctataaacaagttacttgtccagtctggtctttggatttctcatctgcagaatggaggatactggtagtacctgccttgtggggtggttgtaaggattaaatgagatgacacatgtaaaacacttagtgcagtgtctgttccacagtaggcacttaaaaagagtagcggcaagatgatgctgatgaaacattctccctgggttcctgtctcccctcttcacttatctacgtctctttctctctttaaaattacaagcaaaatttaagtcccagaaagcagcctcttttgactaatggtttgtcctgatctctcctttacttggcgttctttaatatccatgtacagagtttatatcatgttaatttgcttttttcctgttttttaaaaatgtaaaatgagagagttgataattgttaagacatttcaacttctgagcttcttttattctgattttgggttctgggtacaaccttttcagattcctgagcacacagccatttgccaatggatctgtaatgagtgccacactcaaattaacagatggtgtggtgcgcttgctttgaggggtaattactctttcatcttaatttcctccctttggcattccttctttggatactgttcaatggcaatgccacgaagcataggatgaaaatcaaacaagtagcaggtcacttgtctatctcagacaaaattattgttaaaactaagaaccagtgaaggtctaccaagtgaggggcttgtaacttctagtattagggaccaagtaactcttaagggtacttaattgtctgatcgttcctcctttcctaaacaaggtggctatttctagttgataactgtctccatttttcttaaagtttaagtagattcctcctctatggccatcatgtcacacctctcacagttggtttgttcttaaactcttaacactgtaagccaaatctgatgtcctttcatcgttggagccagttgtaaactgctaactttactatataaactcctttcccctatcttcttcctcctctctcgtcacacacactttttcccctgatgcttcttatttagttctttctccaaccctccctgctttcacctcagcctaattctatccttttcccctctaggcaatttctcattcatcactgtgtttttacagagaatagaaataatttttaatgacattgagaattttttttttgggttttagtggttcagtcttcccttgtgaagatttttatggcttatttttatttggtaaagttaccttctttactattttttctctccttccacacaattcacagtatactaccatgagtgaggaaaaccctcagtgaataagcgctgatcaatttatttctctgaacattaccaaacaacagatgccatccaccaatgtttgatccccagggcagttcttatctaccttattttacagattccagaggtgaaatgatctattgtaaagcagtgcaaggatcagaagagagtttgtgtttcctggatatattatgtgacttcagggcattgttctgctttccatttgaaatctcaaaggctattggactgacaggaagttttcattcctgttatgaaagggttactgcctccagtttggaagagatgttgcttagggaaacagcagcagattatagcagtaaagccagaaagatcagggagtcagaagtattactatgagatggaaggaaatagctggtgtgcctaactagctcaggggcatgtttgatagtacccaggtatgtctacagaactggcacctgtatagatattgacctctcagtgtgtgttttactttttactctttgagttggactgctgtgttttctgtgtcactggtaattccattgaccaaaacacttcagttgaatcacagcttgagtcttcaagtttccttccctctaaccttgctggtttcttgctcatgttgatatttaagaacgttttctttcaattcagcaaagtttccggatacaagattaatttacacaaatcagtagttcttctataccacaacagcgaccaagttgagaatcaaatcaagaactcaaccccttttacaatagctgcaaaaatatatatatatatatatatatatatatatatacttaggaatatacctaaccaaggaggcaaaacacctctacgaggaaaactacaaaacactgctgaaagatatcatagacgcaaacaaatggaaatacatcccatgctcatgaatgagtagaatcaatattgtgaaaatgaccataatgccaaaagcaatctacaaattcaatgcaatccccatcaaaatactaccatcattctttgcaggattagaaaaaacaatactaaaattcatatgaaaccaaaaaagagcctgcgtagccaaagcaagactaagcaaaaacaaaacaaaacaaaacaaaaaacaaaaaaacaaatctggaggaatcacactacctgatttcaagctatactataaggccatagtcaccaaaacatcatggtactggtataaaaataggcacatagaccaatggaacagaatagagaacccagaaataaacccaaatacttaacagccaacttatcttcaacaaagcaaacaaaaacataaagttggggaaggacacccttttcaaaaaatggtgctgggataattggctagccacatgtaggagaattaaactggatcctcatctctcaccttatacaaaaatcaactcaaaatagatcaaggtcttaaatctaagacctgaaactataaaaattctagaagataacattggaaaaaccttctagacattggcttaggcaaggatttcattaccaagaacccaaaagcaaatgcaataaaaacaaagataggccaggcgcggtggctcacacctgtaatcccagcaatttgggaggccgaggcaggtggatcatgaggtcaggagatcgagaccatcctggctgacacggtgaaaccccgtctctactaaaaatacaaaaaattagccgggtgtggtggcgggcgcctgtagtcccagctactcaggaggctgaggcaggagaatggcgtgaacccgggaggcggagcttgcagtgagccgagatcgcgccactgtactccagcctgagcgacagagcgagactctgtctcagaaaaaaaaaaaaaaaaaaaaaaaagaataggtgggacttaattaaactaaagagcttttgcactgcaaaagaaacagtcagcagagtagacaggcaactcatagagtgggagaaaatcttcacaatgtatgcagactaatatccagaatctacaacgaactcaaacaaatcaatgagaaacaaacaaacaatcccatcaaaaaatgggctaaagacatgaacagataattctcaaaagaagatatacaaatggccaacaaacatatgaaaaaatgctcaacatcactaatgatcagggaaatgcaaatgaaaaccacaatgcggtaccaccttactcctgcaagaatggccataatcaaaaagtcaaaaaacagtagatgttagcatggatgcggtgaacaggtataacttccacactgctggtggaaatgtaaactagtacaaccactatggaaaacagtgtggaaattccttaaagatctaaaggtagaactaccatttgatccagcagtcccactactgggtagctatctagaggaaaagaagtcgtcatacgaaaaagatacttgcacacacatgtttatagcagcacagttcacaattgcaaaatcgtggaaccaacccaaatgcccatcaaagaagctgtggtatatttatatgatggaatactaccagtgataaaaaggaataaattaacggcatttgcagcaacctggatgagattagagactattattctaagtgaagtaactcaggaatggaaaaccaaacatcacatgttctcactgatatgtagaagctaagctatgaggacgcaaaggtgtaagaatgatacagtggactttggggacttggggggatgggtggaaggggggcgattgataaaagactacaaatagggtgcagtatatactgcttgggtgatgggtgcaccaaaatctcacaaatcaccactaaagaacttactcatgtaaccaataccacctgtaccccaatcacttatgggaaaaaaaaaggttaaaaaaaaaaaaaagaactttttctttcaaaaaaatgctgatgaaatgcaagtttttagcttctttttttcttgtcatttccactgatctgggctgttttagataggatgttttcaaaagttttatcatatggctctattctttttggcttattggactgcaagtgtgctaaggcccagtcattcaagattgattagttctttgtggtactatatgggcattttggtgattgtcatttctcaaaaatgatccaaaaacgattttccacattgtttaaacacactgttattactcttaacatcccaatagttattgaggtgtttattattgcctttttcttttaattggggtttttattgcataggaaaggggaaaagccctgattcaagcatttggattcaggtcctggaactgccactaactctgtgtgatctcaagcaacttgcttcctcgctttgggttccagtttttttcatctgtaaatgaagagtttggattggaatgacttataggtgcttattattgctaatactctattactgtttattgtatatttaatatggaaagattgtttggaaagtggatgacattttggctggattttcctgtgtatttctaaagaccagggcaaggtgggaaatctgactcttactcctggggctttgggctgtaataatccttccgttgtggcaagaggaatgagggtgagacattggtgaagttggcttttgttcaacattctgagcttattccttcttttaggcttttgtttgcatatgtttagcttaactctgctttcaagtgtgtgtattttcgtggaaatggtcctcttttccttttacaccaaattcatgttctcatcttccttctcccttactgaatcatccatttctgaatagttagcaattttcaacttaatgaggtctttcccctaagtgaagaacacagctgttcctcctctgatactttggcagctgcctctgcctttcccaaaatggaatgattagctctttcctttgattttttagctggccattagttcaggactactagcccatttcctgtgtgatggaactaccaaatcccatggccagaattgttccaatttgcctttagtgtcttttagtcttctggggacttaattcatatgaagtggaggatttatcaatctttcagaggtccatttgcctcattatctccagtgatttcattgttcagccttttgagatgctgatctacgaggagaacctagcctggtgtccctgatgtggttttgctggagaaatagcagataagaagatcctcaatgtattttgttcctgaatcaaatagccctcatttgtcacaggatctccacttcagtttctgaaaagcccttttgcctattccattttagtcttatgtacctgtatttaagaaagtgattactgtttttcctcatgtactttgacttcatctgcccctccagcctttaattttatgatttcacatcccttgttaattgttgggatttccttttatcatatgtgtcccttacacttaagatatcaagtcaacttctccactccactccaattcccctctcacattatgctccctgttaatcaatcaaaagcattgtgggtttagtagtgctgttccaaatgtgtgtggtgcagcccgtttttgcttccccaccccaaacgcctcattcaatttaattccatatacttagcatattaggcatcttgtcaatatttcctttctgaggtctatttttaaaatttgaatgcattctgcatgtgtaggtttttttttttcttaaatgatgagatctactgcaacagagagccagaattagctctgtgcctaggagaaaaggaaagcacagagggaaagaatatttctcacattctcagaaggtgtatgcaagagccagcccttggcacaattatttatacagtgccactatatctatctgcgtgcaccttcccctccatttgggagcataggcatccagtattctccttgggttttcttagtttctgtcaccattaacccttctactcagggccctgcattcccagtctttcctcgtttcctactttccccataaaaaacttacctggtccatgttccatttccccaaaatcctaattatttcaagggacctgttaaaatgacctgttctttctttccaaatagtatttgtatctcaatgtgatgataatccaaaagaatacctaatggtggcatttgggtcaccaatgcagcctgatggcgtgatgtcttcaggatatggccttttccccagcatcagttcctttatatcccaccaatagttggctacatggtcaaatgataaggctagcttggactccatttatcccagagaattagagctgcttgatgaataataatacctacctaacatatattaaattcttccttagtgcgaggcactgtgtagctcagcttccatgcatttcctcttttagtcattccaacaattccttatgaaggtcagtgctattagtcctgacttatggaagggaaaaaaggcacacagagtaactttaagtaacttctataggatagggctgttaagtcttagatctgggactctaaggtagtctcgctccagagcccatagtcttagactctgctgcactgcctctgggaaaaggatggtacctttttcacatgtacacctcactcagaagagctaacttcagatgtgctgctgggtagtaagcttccctttggcaaggaacaaatgaagtcttgagttgctccagtagatctagcttatatctcatcctttctggagagaagtttgcctttggacacaatgctacagcagaaaggtttgcctttgcttttctgcaccccaaaacttagcagtattaaaaactttcttcaccagtccctgtagttgtaagtcatcagtagggatatttgccaaatgcttaggaccaagcttacactctatcttttctctaccttcagagctgaaggagctatgtatgtgtgtgtgggaaggaggctctctttggtgttggtgagcatgaatatgacagactcggggtagggggatacatgaaggggagagcagactcatccacactctcaaggcaagtatggttagaaaccctgcttcactcaggtagcgctagtctcttcactgtaagtaggttttttttttttttttaaatatggtgatacaatgaattgttttctgaggtggatggttgtgttttctgttattactgcttttccttctggaccgaacttttattggctgctgcttacttactagtagaatgcttcacacctgtgggctgctgcagtcatgacaatgaacattctgttcagaaggggagcattcattctctttcccagcagctgttaccccaacattgggaatttaatgcattcatttgttctttagataaataggattaaattcagaatgaagcaaggagtagtcttagtctgtgctttgcatgattttcagggtctgtacagttccagctgtgtaaacatgattgcagaacttaagtatcgtctaatgggggaggatttcaatttaggagtggcacaccatagctgggctggagccagacattcttccacccacttcagtccacaccctgcggagtcggcttgctcagctcctagagtcagaagtgaagatggggcagctgtagttaattatactgtattatagcttcttatcagtaggggatgagaactaggcaagggctaggaaaatctaaaattatatcctcaaatatgctccagttatggcagtaggaaacaaagaaatggaagacattggacaaagtagggcagccccaaatattaaatatgacaagaaaaaatccaataaaatatctattgaaattgtagctacatttatattccaattgattcttttttgtggtcactgaaagcaagagtagagaaatattgtattgattgtaaaatattgatttgttctaatatttggactcagttttgttttcttgagatttgtttaaataatgaatagctaagtaatgctaaagacttctaataaaggagcactattattatggaaggaaatgcaatttcttcataacaaatacaaatattatggatcatccaattcctttgtccttgttcctccacccacaattatgtacagtgttggccctgctcagttcaatagagtcttagatccagtaattattctgtctctctaaagaggaacatgggcatacgtattcctgagccctaaaggatgggatttctgatgatatagcaggttttgtttgatgccatagattctccaggttattcttgggggagtatcattgatagctaacacaaaggtacttggcttcctactggatatgaatgtcaagacatggtcctgatcaaggaagacaacaaagcattgccttttgaatgtgctggggattgtaatgcatttaggaataacccaatcaatgatattcgttcctattacaactggctattgaaaaactatttttctgagaagctcacttcaaaatgtctctgagacagaatattcttttataggatggggagctctggattgaaaaagagaaatgctaggctgataaatcactgagtttgaatcatatggaaagtgttcaagaacagaaagagaggaaaattcaataaattactgttgatgcaatattggatggtcagggtgataagacactcactagagatttccagtctatgatgtacacacatgcattattttgtttactagttgtggtagcctgaagaggcagaaacatgcctccagaataccagcagggcataggggaacctctccatcatccatcatattcaactgtagtcggggggtgatcctgtcaatattgcctatgtggtatctctggaacttgggactgggatgcctattagtgcttcactgaattctgtatttgtagcatgtgcattgtagcatgtacataccatagcacttagctcgtggatgcttgtctgaatcattaggtatgaacattatgggtgccataatagcacaggaattactgcaactaaaaaggaaacacatggcttgtacttcatccacaatcacttacacttaagctattgatagttgattgggatatgtgaactgctgggcttgtgccatgggacttctaagcatatttggtgggcggaacagacaggaaggctgtagattttggcaagctgtggttcccattagtcaggctaactgtatctgacagtagagatcccaattcaccaagatgaagcttacttctctaggttttggctgatggcccaacaatattgacgtgaaggacaggagaggaccaatgttacgttaggctgtgagtttctaatgagcaaatagttgaatggtttagtgaataccctgttggttttttggtggggtaaacacaaaattcataatttgagagacatgtaagactcgaaattttcttttatagtacatgttaaccattcattctcctaatagggaaatgtgggctcttttatagggtgtgcatattatgtagttgtacagttaatactcttctctgtgtttttcttgtaaggggtgctgataacataccctactaaggaaattccaggcacagctgtttctaataataggtgccccaccccacagaattgtcaggcttactctcaaggttctttggtgggaaggaggattttctggcagagtcttggccactgccattgtctcagattgcctccctgtagcttccttggaggtatgagtttctaagcagaaagatttgctgtgatgagggaaggccacaaaactgaaggaagagagatgaggtcttatagaactaagtgagaggctgttttggtcatggcagagatgagttgaacactatggaatggagacaagatgagaagaggagtgggaatcaattcatgaaagcacttattatttataagttggaataaaaggttcattgaactccaggggacccttcttatatgaaatgcttgtgaatatgttgaaattttgtaacggcaattccatcttaaatacactgggggagctgacaacctgcagttcatggattattctatctagtgtacaatcactcttctattctaccctggacattcttccaggtgtggtcaagagaaagcggatagaacagatggaatatttcctctcaggagagttcaagagcttccttaaacaaaggcaagatgtgagcataaccttttactttctaaacaactttttctgagagctacctggaaaaatttctagcttcctcacagatccaagtaatttctgaaaatatttagagactagtaatcgtttaacttctaaaaatcaaagttggtttgtgctaaaaatatcatccggacagtctgtgtctagttgagtggggaagaaaaaaaggcaagctcttggtatcaatctttattccctctgtaaacacacatgaccagaagagaaggctgttattaatggtaatgcagaccagaaaaaagggtattattttcagtctgttgaacagtacaaaaatgcttctcaagcactgtgttcagatgtttctttttattagccatcacacaaggaattagactcatttcaaacagttcgtttccctactcttgtctccgtaaaatcgttactcatgagtggtttctttgttgaaatactgctgacctcccatattggaatgcacaacagggtgttaaaaatataaactttttagtttgcataaactctggaagaagggggacaaagattccccaggagaataaaaccattcgccaatgtccttgtttattagtgtcctataagcatcttattcaggaagctatgtcagcattacaattctgtatagactttgtgtgtgtgtgtgtgtgtgtgtgtgtgtgtgtgtgtgtgtgtgtgtgtgattaacagcagagggctctttgaattccagcaggaggttttaaaatataattctgcatctgcccctctttcttgtcctttccaacccttttctacctcccttctcatcaccgacccatccagggccattaggatagataaaggagttgtgccatgtcttaatatatgagcaaatgatgatccttagctctacagctaggcgctgtttgcattttgccaaaggtgattattttatctgcagttttaatagcaaaccagattatttgctgttcactaactaataaaagcaaataaaaacagattgcaaagtggaattaaggggataagaaagtactagagccaaagaaggctttttctttaattaataatttccatttactcttagaatatttttatgctagagttcaacatcttatattaaacatgtgtgcacccttcctcttataactgccgaattggaatctcagaatggaaatcatgcaggcttgaacggagcttcaaattctcccagtgttgtcttattgtctgtacacagaactagactcctcagggcttcccccaccacagcatggcattcctccattagccccatgtttcccagacccagtcatgaagaactggcattttaaccaacaagtagaaaacacaataaaattggagttcaggagatgcaatgttttggagaaacagattattccaagagtgtaaagatacatgatctaaagatggacagaacatttaaatttaccagcctggttttcagtgattttttgatttgttcaattaatttgtgaatgaaaatgcatcttaaggatggtgaggactggtggtagtggtggtgaatgtgcgtgtgtgtgtgtgtgattttgtggccatgatccaggcttactatgcatcagctcctaaagagatttttacagagctgtgtctgagtgtcttaattcaggtcatctcaaccagagagccttctgctactcctacgtgcaaaggctcgagttaactcagaaaaagttctcacagctgtggcccagatagattccaagacttctctgaaacttcagatggaagagcctttctctttaatagagagccattctctctattaaagaagagttgggcaagctggaggccagaggattatattgtaatcttcatgtgctgaaaggtgtaaagaatcttttcttcttaataagagcactgggacaagcatagggtgccttcaaattatcagacttcctcaaacaatagatcaattagcctttcttctgaatttgtgtaattgtttttgaggcaacaccctgaaaaaatatagcttactttttccgactagtataattaagcggacaaatggaaaaagaatcattcaaagtaaattttaaagaaaagagcaaaagagtaaaatttagcattgtccatgtaagatggataatgacaagtaaacacagaaggtggtgtttgatcccttcgattttggtattcattattcatagttattattcataaattccaggttaggcttgtgccccagtgacacatttgcattttactttaagttgatttctacctggttttgcaaacaaggatttaatgatttgggctgcctctcactcttcctctgttgcttgtcttttcatatacagtgctggcttctagccccttttacaccctttgtctccatcatcagtcttgctctcccatccaatgttttactctcactctctttctctcttctctcttctctctctctctctctcaatgttttaggaaaaaagatttctaacgtggaaaactgatatttgaatagagtcccctaaggctatcaatttacttttaatttgtctggagctaagcttttctttgttgcaatgaggaaggattaaaactgctgtaaaatttattagcttccagaaagatatttgaaatgcatttttttaatgattgtgctgtttgctgtacccagaagcagtgtcatcacaactatagtattccagatggttcccgaagttacactgaaacatcaagataatgctagacttttttatgacgcctctattggtaatgaatagtccatcccaggtagctaatatatattaattaatatatatttgtttccaatgaccatttctagtgatacccagctgatgacaaaacacacacactatccctttgaatcattacaggagacagtgattggtttactgagctctttattttccaaatgtggaagaaatgattggagatttactaatgctgtttcttagcttccccacccagtcctaggaacatattggtagtcaagaacctttaaggaatttagaagttacagttgcaacatttttcatggactcatgtatagtatggcctattctacaaaactgaatgtcctgggacttgactgaaggaagtgtcagttcctgttaaggggaacaccagctgctgggtgccctttttgttccattcaacagtaagttttcattagaaaagggaagatttttctcttggccaacgtgctctgtctactcttgctttctgtgtcagtcttatgtgtgccatcttcactatgtattctcctagaagctcatgaccatcatgaaagtggcttcttcacaagctgatgatctgctagcagtttccttattttccacaaaagagtgaaaccaagttggagataagtttaggttcagaactattttttaagtgtgataggctctgtgactgggcgcggtagctctctcctgtaaaccctgctactcctgaggctgaagtgggaggatcctttgagtccaggattttgagaccagcctgagcaacatagtgagattctgcctctaatttttttttttttttaattagccaggcacctgcctgcagtcccagctacttggaagaccgagccaggagaattcttggagtccaggagttggaagctgcaatgagctatgattgcactattgcactccagcttgggcaagagtgagatcttgtctctaaagaagtttttttttaatttttttattatttatttatcatttttttgtaaaggctctgtcatcctagatgtataactgcatgtagaatgcatctgacttttaaatctacaccaagtcaaataactgatttgaactcttcagagaagtgacaagatgttgtaggtatcccactaatataggtttgagggacttaattctgtgggcgtctttatatgaaactttcaaaaacggtcctatgtttttcagagttgtagtatctcagtgttctatcttttggggaatagctcattggccttctgtgtcacctcatatttactagtaaagttgctttttcaaatggtttataagcacctagatgaagtccagcactttgtcagattattttctccatcacagaagccaaaatacaaagatttcagtctagtcaatctctgcttatctcagtcactgtcagcacctcttatttcttagtctcaattttccaggcagccttttgcttgatttccttgctccccatgcatcagcacaaatgatttatacttatgtacatcttgaaatctcttctttatggattgaattgaatcgagccccagtacaaaaatgaaaactccaggaactgttgtgattgcccaaattacaacttggattgtatgactgtacacgccacactctcatctatcataaatattaaattctcaagcacttatacttcaatatgttttaactttgtctgtttgaccagctcagcactaaagattccattgaagataattcaattgctttgaattctgaaaggggcatctttttaatctattttcatgttgcactgggagttaagtgaatttcaggtgcatagcctgtgaatgatgggagaggcctatgtgccatttggcatcacagaggccaaatattgggtgacatttgctaactaatgctgatcagtgaaatggtctaggacaagattggggttcatcagtcttttcagccattctccctatctcaaactaaaactaaactttgcagaatttctgctgttttgtcagccatactgaaaatgccaagttatgctaaccagggctggccttttttcttctgtcttgtcttttggcaacatccctttgccagtctcaggaactttgttcccacaccccatccccatccttcatccttcctgaggcatctccacatccagacatttctagtgtttttaaccccatcaaatctctcttatcctggatacccttattcagggctctgttatgtgacccaaaaaaatctgataatctcagttcgataatggtgcctcttctaaacatttttttaaatttattttttattttaatagtttttgtggaacaaatggtgtttggttccatgaataagttctttagtggtgatttctgagattttggtgcacccatcacccaagatgtgtacactctacccaatgtgcagtcttttatctctcacactcctcccaccctttcccctgagtctccaaagtccattgtattattcttatgcctttgcatcctcatagcttagctcccacttattagcgagaacacataatgtttggttttccattcctgagttgcttcacttaaaataatagtctccaattctatccaggttgctgcatatgccattattttgttcctttttatggctgagtactatttccatggtgtgtgtgtgtgtgtgtgtgtgtgtgcatgcatcacattttctgtatcctctcattgattgatgggcatttgggctggttccatatttttgcaattgcaaattgtgctgctataaacatgagtatacaagtgccttttccatataaggacttcttttagatacctagtagtgggattgctggatcaaatagatacacttttagttatttaaggaatgtccacactgttttccatagtggttgtactagtttacatactcaccaacagtgtaaaagtattcccttttcaccacatccatgccaacatttattatttttttattatggccattcttgcaggagtaaggtggtatgacattgtggttttgatttgcatttccctgataattagtgatgttgagcattttttcatatgcttgttggccatttgtacatcttcttttgagaattgtctattcatgtccttagcccactttttgatgggattgttggttttcttcttgctgatttgtctgagttccttgtagattctggatattagtcctttgtcaaatgtatagattgtgaagattttctccctctctgtgggttgtctgtttattctgctgattatttcttttgctgtgcagaagctttaattaagtcccatctatttatgtttgtttttgctgtgtttgcttttgggttcttggtcatgaagtctttgcctaagccaatgtctgtaagagtttttccgatgttacctttagaatttttatggtttcaggtcttagaattaagtccttgatgcaccttgagttgatttttgtataagatgagagatgaagatccagtttcattcttctaagtgtgacttgtcaatgatcccagcaccatttgttgaatagagtgtctttcccccactttgtttttgtttgctttgttgaagatcagttggctgtatttacctttattcctgggttctctattctgttccattggcctacgtacttatttttataccagtatcatgctgttttggtgactatgcccttatagtatagttctagtcgggtaatctgaagtttccagatttgttcttttgtttagtcttgtttttgctatgtgggctcttttttggttccatatgaattttaggattgttttttctagttctgtgaagaataatggtggtgttttgatgggaattgcattgaacttgtagattgcttttggctgtatggtcgttttcacaatattgattctacccctccatgagcatgggatatggttccattggtttgtgtcatctataatttttttcagcagtgttttatagttttctttgtaggggttctttcacctctttgcttaagtatattccttattattattattttgcatctgttgtaaaagaggttgagttcttgttgattctcagtgtggttgctgttggtgtatagctgtgctactgatttgtgtacatttgattttgtatcctgaaactttgctgaattcatttaccagatctaggagctttttggatgactcgttagggttttctagatatacgatcatatcatcagcaaacagtgacagtttgacttcctctttaccaatttagatgccctttatttctttctcttgttggattgctttggctaggaattccagtaatttgttgaatagaagtggtgaaagtgggcatccttgttttgtttcagttctcagggggaatgctttcaacttttcgccattcagtataatgttggctgtgggtttgacatagacagctcttgttaccttgaggtatgtcccttctgtgctgattttgctgagggttttaatcataaagggatactggattttgtcaaatgctttgtctgaatccattgagatgatcatgtgatttttgttttaaattttgtgtgatgtgtcacatttattgacttgcatatgttaaaccatccctgcatgcctggtatgaaacccacttgatcatggtggatgatctttttgatatgctgttggattcggtcggctagtattttgttgaggatttctgtatctgtgttcatcagggatattggtctgtagctttctttttttgttatgtccttccctggttttggtattaggatgacactggcttcatagaatgatttagggaggattccctctttctctgttctgtggaatagtgttaataggattggtaccaattcttctttgaatatctgatgaaattcagctatgaatctgtctgactcttgttgacaattgttttattaccatttcaatctcactgctcattattggtctgttacgagtttctatatcttcctggtttaatctaggggagttgtatatttccaggaatttatccatttcctctaggttttctagtttatgcacataaaggtgttcatagtagccttgaataatcttctgtttctctgtggtatcagtagtaatatatcccgttttgtttctgattgagcttatttggatcttctctcttcttttcttggttaatcttggttaatcatttttattcatttttttcaaagaaccaggtttttgtttcatttatcttttgtattatttcttttgtttcaatttcatttagttctgctctgatcttggttatttcttttcttgtgctgggtttgcatttggattgttcttgtttctccagtttaatgaggtgtgaccttagattgtctatttttgccttttcagactttttaatgtaggcatttaatgctatgaactttcctcttagcaccgcttttgctgtatcccagaggtttggataggttgtgtcactattatcattcagttcaaagaatttttcagtttccatcttggtttcattgttgacccaatgataattcagaagcaggttatttaacttccatgtatttgcatggttttgaaggctccttttagagttgatttccagtttttccactgtggtctgagagtacttgatatcatttcgattttcttaaatttactgagacttgttttgtggcctatcatatggtctgtcttggagaatgttccatgtgctggtgaatagaatgtatgttctgcagttgttgggtataatgttctgtaaatacctgttaagtccatttgctgtaggttatagtttaagtccattgtttctttgttggctttctgtcttgatgacctgtctagtgctgtcagtggactattaaagtcccccactattattgtgttgccatctatcttatttcttaggtctagtagtaattattttataaatttgggagctccagcattaagtgcatatatatttaggattgtgatattttcctattggactagtccttttatcgttatgtaatgtccttttttgtctttttaaactgctgttgctttaaaatttgtctgatgtaagaatagctattcctgctcgcttttggtgtccatttgcatggaatatctttttctaacccctttaccttaagtttatgtgagttcctatgtgttagttgagtctcctgaagacagcagaaacgtggttggtgaactcttattcattctgccattctgtatcttttaagtggagcatttaggccatttacattcaacattagtattgagatgtgaggtgctattctattcactgtgcaaattattgcctgaatacctttttttcattgtgttactgttgtatagttcctgtgagatttatgctttaaggaggttctattttcatgtatttcaaggacttgtttcaagatttagagctctttttagcagttcatatagtgctgtcttggtagtggcgaattctgtcagcatttgtctggaaaagactgtatctttccttcatttattaagcttagtttcactggatacaaaattcttggctgataattgtttcatttaaggaggctaaaaataggaccccaatcccttctagcttgtagggtttctgctgagaaatctgctattattctgataggttttcctttgtaggttacttgatgcttttgactgacagctcttaagattcttttcttcgtcttgatttcagataacctgatgactatgtgcctaggtgatgatctttttgcaatgaatttcccaggtgttctttgagctccttgtatttggatgtctagatctctagcaaggctggggaagttttcctcgattattccctcagatgtgttttccaaccttttagatttctcttcttccttgggaacacccattattctttggtttggatgcttaacatagtcccaaacttcttggaggttttgttcattttttaaaattctttttctttttctttgacagattgggttaattcaaaaatccttgtctttgagctctgaagttctttcttcttttgttcaattctattgctgagactttccagtgcattttgcatttctctaagtgtgtccttgatttccagaagttgtgattgttttttgtttatgctatctatttccctgaagacttttcctttcatatcttgtgtcatggttttgatttctttaagttggacttcacctttttctggagccgctttgattagcttagtaattgaccttctgaattttttttctggcaattcagaaatttctccttggtttggatccattgctagtgagctagtgtaatcttttgggggtgttaaagaaccttgttttgttatattaccagaatactttttctgcttccttctcatttgtgtagactgtgtcagagagaagatctaggactcaagggctgctgttcatattcttttgtcccatggggtgctcccttgatgtggtgttcttccccttcccctggggatggggattcctgagagccgaactgcagtgattgttatttctcttctgggtgtagccacccagtggagctactgggctatgggctggtactggggagtgtctgcaaagagtcctgtgacatgatctgtcttcaggtctttcagccgtggatatcggcacctgctccagtggagttagcaggagagtgaagtggactctgtgagggtccttggctgtatttttgtttagtgcactggctttgtgttggttggcctccagccaggaggtggtgctttcaagagtgtatcagctgcagtactatagggtggatgctggatcatcttattttaacaggcattttttaatgcatgtatccagatgaatgaaaaatgtggaaatttttctccatgctgcaagggctggttcttggatagcacttctttggcatctgtcaggtaacaccacataggtgttttgaatgccaatcagtgctggcatcctttcccttctgcctgatgtctgtctgtcattccatagtgttgtaggggagggctgctaacaaggacgaggctagggaacgggagaacaaaaagaaagttttagggagcaaccaaaagtggagaaaattgctgaaaaaaagggaagaagggagtgagaaagagacaagtagttgtttgtagtgtaatttgtgatgtgcttcttgtcacatagagtgactacaggatagcttggtatcattggttcatgagtgtctacagatatctcagccttcactggtgttcccttgaatgttttacggatggaattccatcttttttttgctaaaattttactttagaatacgactgtaaaccccctgcaacattacagcctgggagggctctaggaagttgtcattacgctcatattgaatttttgctagatacataacagatattttccatatgatatctaaacacccaaataagcccaatcctcaagatatcaaacatatcaaaaccaaaataaaatgcctaaagccttggtaatattttccttccttccttccttccttttttccttccttcctttcttccttccttccttcttccatttccttcctttcttttccattgatcccgttgctgctttacttgccttgttaagttacagagatgggattgataatagtgcaggagagagcactattaactattgttagtatagaaaacttgcaggtctatggcaaatgtattttcaacgggatgttagagggtactagatctctctaacacctgtatatagtgtgcaggaaaccacacagaggctaagaggacacttaatgtttctcaagttctaaatttactttacgcctctgacaaagctacatagtttactttgtaggtttctgtagtatttatgataaaatagttatttccactttaggagttgcacagtatctggggtgggacagtatctggggcgttgaccaatattcttccttctttctgtgcatttttcattcaattaaattaaactattattaacagtttaattgacagctctgtgctggacgctttgctaggttgagatagatgtaatctttgctcatccagagcttaaaaggtagcagaaaatatagacatgaaacaagtacagttgtctcttggcatccatggaggattggttccaggactcctgagaatacgaaaatctgtacatgctcaagtcctgcagtttgccctggggaatctggtggaacctgtggataaatgaaaaggtgaccctacaaatctgagggttttgcatcccacagatgttgtattttctattcacattttgtggcagatgcagaacctgcagatacagagggctgaccatatttatttttaaaaacctacatgtaagtggacccatgcagtttcaaacccatgttgttcaagggtcaatggtaattacgcgtgtgatgaatgttataaaagggaagtgctgtgagatctaccttagtctaaaggatcacagaaggactccctggggaagtgaaatttaaatggagacttcagggataatgtattaatcatgaattgtgtttaaccgctagtaataaagatgcccctctcctactaaagaaaataaatcaatgacttaaataagagatatttatttttcttcttattaaagaagttcaagtttggtgagggtagctctacagtatctttaataacccaaggtccttatatctttctattctgccacccacaggcacatggcttctatcttcagggttgcctcatggtagtcagacagatgttgcagcatcagtcattatgtctccattccagacaggacaaagcaggaaggaataaagacaaaatagtctcttacctaagtcagctctccccttttaaggaattttcttaacatcttgctttataatgttggtccaatcttatgttacatgtctgcaagggagcctgtgaaatgtagtttcttttagctgagcacactgccattcctaacagaaatggggctttgtttctatttaacaaaaacagataaagatatttggcaggcaattagttatctctgcttcatagagtaggagttagataggtcaagggtgggtggtgtacttctcaacaattaggtttcctcgattaggcacatgtgaccaattttaacagcactaaacttcttcataatcattgtcataatctcctccattatatctcacaaaaaatggccctgctttggttacagattgtcttgttcatgaggtgatgcagaataaactaagtagatgtataagagtacaattcaggaagcttgtctgatatacacatcacttgcttgttggttctactactgctgccacttagaagtagccaactacttgagctctcaggaactggaactcactttaacttttttctttctgattcattgattgcagattatttctgaagaggaaacatattgctcttgtaactgtaaccttgaactattttagtgctggattttcgtctgtgatcattaggatctttgagttaatacacccaaactctgaatcacagtaaagaactgccagcattatcaaacacatccattgtgactggatatctatacaaacccagcagagcctcttagctcttctattccaccaggacttggaaagttttagcaaagcctgaaatgatgttttcatcattttcttttattactttggtggggaccatgggtaggctctttctagtgtggaagtacattgtttggccacatctgaggagatggcagtttcatgtcctgaggagagtagtaattgctgcataaagttttgctattatctgcacaaaatagcatattctggtctttttctgtttgaattacttccttaatctatcatgacttagtcattactgccttactgcctcttttgcctcttgtaccctcgcaagactgatgctttaattttttttttttttttggccaggggttttggaattctctcaccaagtttcctgatgacaaattgtgaccaccaaatacttactgctatgtagattgaagaaactttcacttttttctgtattttttatggtctaaaataatcagatttgttttgaactaaggagttctctggtctcaagatttgtgttcctcttccaaatttatgcactctgttcttgtttcttttgcaaatcctagggacaacttcagaagcagggaaaaccaatttacaaattcatcagtcaaccctcatcatgagtatgtttaaattaaagacacctgccttcattcatctatacgtgaatttccacaactatatgtggattttagaatgccacattttgctttgcctaggttcaggtcagaactttcagataaaaatgtagcaaagtatcaggtcacagataggttcataagaagaatctcagcaggaacttagtgaatcgtgagcccatctctctatataagctggagccagcaccttgacagtttgtgatgctacaaaatggttcttctctagtctcatagctccattcccagccactatactacatgaggactggcacataatctttacaagtcctatacaattacagaagtagtctttttaatttttatttttttacatctggtctgtcttcattgctatttttaaggggctttgtattgtgactttctcacatttactacacaatttctttactaaactgaaattttgatttttgaaaggtaattcatctgcagtatatttatgaatgtaaattaccctgtgctgggcagagatgttcttcctgcctgtctatattgacaatttttatttcatatataaagtggctataaacatatttaagctaagttagacttcattgtaactgtatagacaaaaatgtcacaaaatatctgaaacacaaaaataagaaacagtaactcagtgcccttggtaaggacttaaaaaaaatataggtatcagatccaagccaaggatgagacactgtgagtaaaagagtctcttagattcaagtcttcacttgcgtgaggaagggcagtgcatataataagtttacataagtaatctgagaaaactgcatatgattccagctcatatggagctgaggtaggctcagtgagcttggtggggaggcttagactgattgcattgttgggtgtgtcctgagttagtctccgtttctcttttcccaacagtgattgtttcatttagacagtgggtcagctgaaggcaagtactatctatacagagaaacctcagagaagattgaattccctgctctggtcttccaagatttataagatcttggaggtgtctgtctctgggctctctattctccctccccagatattctggggatccaagtctcctcatgctgttcatttgaggcagcctagtatagggaaggagcattgtacttggattcagggtgacacatgggtggtattctcctattgaatgctgttgaaaaaaactaaatctcaaaattagaggacagtcacttcatattaaaaaactcaaagaaataagagcttcgtgttgaagacattgggcagatggtactcaattgtacttcactactgctctgctctagaagtgtgagcaagtggcctgaaatatcagtcttaatcttggctgggattttcttttcttagttggtcatatgtccatggtttcagggctcaagggttaggtctttatgcttttatgcctttcaggtagggacaaaaagggcagagatcttatagccttctggacatttttttgctggcttccagggatttttactctgatttgtagaaatggaaataatttattgaacttttcccccacctgcaactgcttactctctctaccctgaaacactctcactaattttttagaggtattatttggaaagttaccagataggccttggaagagatgaagaggcaaaaacagcttattgggaagccctaaagatgtgacttctgttctactgaagggatcttgggacctcctgtggaaagcactatatttggaggaaactgattaaaagtagatcaactaactcttccactcatactgtttagtctacacaaagtgcttctcaagtatatcccaaaatgcttcccttactttcatattttctgcctcccaggtacatgcatgttgaatgataacagggtatcagatggcaacacagagagtttgcagggaaggggcggagaaagggccttgacagacctttcattttgcagaagtggccatgcagcctgatgtggaactgagctggagtttgcagaaacattgtcctaactaggtggaaggcactttccctgttcatgatgttgttcatttgttatttggttccactgtacaaaattctgagtgtttcattgcccagcactgaaagggggatgaaagtgtccatcttaaagataaattggcaaattatgtcaaggtacactgaagaggtcttgtctttagtttgcttttaagtagcttaaatgaggtcaagggccatgcccagaattgtgttgaaatctggatttagcttggattaggtccttgatatttaacaggcttctaatgtctttcctccaaataatgaagtgtacagccaattcaaccattattccttgagccctctgccttgtgccccttcaccaaagaacctttgatgaatgaggcatagcagtaccttgctttgctatgccatttactctttaaaaacaatgaagaagcaaacaaaaaacaccaaaaatatagaaatacaagtatacaaggaagatgtgttatatatagactgatgccaagtaagactctgaattgcagacatcttccccctgcaaaataagtcacaacataaatatatatattttatatacatatgtatatataagatatatatatgtattttctgtaaatgttaagctgctcatattttgatgcattgcgcaatgttttcattaggtcatcctcttgtaagaatgtaacataaatataaatagatctggaaaactagggctataaaacaaacattgagattaacagttttccagtaacaggcagaagttaaccctgggtccatgccttggtaaagcctgtgcagtaagcctctctgagagccagattgaagctttaacccttagtgaacctgacctggaaagataaatctatgtctgcccaataattatgaattgtaactgctgagatcttccaggatggagttaaaataatccatgaaagatttctttaagaaatatttctctaacaaaactgcagataagaaagataaggagggatggctagttgggtctaattaacaatgaccaacatgtcactgatgtttgcgtagggccaattgaagcttatgggtcagctggatagaagggctctcagtttattccttctgatgggaaatcaagtcatggaagtggcatagtgaggagattggctggtgggactggtggtcaaaaagaaggggtgtgattgggctttcacagagagtaggatatcaatctaaaattaaattaagcactgtgtatcagtgatgggtagggtggaagggtgtttggcagtgctgttgttcaaaaatatggccaaggcttcttaaatacactgactgttggattcccttccctgcctccactccctcatctgctgaatccagtttcaaacacaggtgatttttagcaggagttgttgattaaaatgctgactctcagcaccttgacactccagatgaactttagaatatatatgtattttcatcataacgtgtttccctttaggttttttgttttgtcagtagtgggaaccttaaaaaggatatacatagagggagatcttcagccttttaaaaaaatccagttcttcacacttgtcccaaaaggcaataaaggactacctaaaagtgccatttcccacaagggcctgtggatatctaagaaaccagaacactggggagtaacagtgaatcctgggaaaagctgatgaaattgatattttcttttttccaaacagatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaa

SEQ ID NO: 4773 - DNA, 116953 bp, human
atggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcaggtaaagccaagttttctttctttgtcttggatgaataaggtgtgtttatctgtgtctctgtgtgaaaatcctggtgcttttgtttcctacttaaatgcatgcagcatacttgcagtgcttctttttgtagggtgaaaagtttgtgacagtccaagttgatcaattcttttgatctgacaatttgctggaagacaatcatttagtgtttgaatggattctgtcacataatgatggtgagcagaaacgcaattatcattttaaaatttgcatagctgtctccatgaagttatggtaggaaaaacagagagagagagagggagggggagagagagagagatcatatttttaggaaaaccaccaactaccacaacttggtgtctggggcacagtgtttttgggacaggtactgaatgaaaggagagggagtgttggcagctaccctgtcttgttgcagtgatgaactctggagagagactgggagtgggagtgtaagatgggaaagggagatgagggggaggagagaacaggagtgtgtggagatgcaggtgattagtggtttttagtttattcttggcttgttttttatctagtccccaaacatctggctatataaagtgaaattctatcaggcatctgtatgttttcaaatatctggttggttggtagtgtggagaccaaacatcccaatgaggaacaagactttgcatccagatgtttcagtaaaaatagcaatcttctagagttgatgatgctttcctctaatgtgagactgtgttgtggcattaagatctggttcctaccagtggatgtcactgtgggctattgtgttacagtttctcttgaagtgtgtgaaggatgtgtgtgtgtctgtgtgtgtatgggggggggagggagagagagagggatagaagggggaggaaaagggagaaaagaagaaacacagtattttttaaaaagatttcctgataagcacattagaaggtcttactgaagccctttcttacatttggatagagcacataagtctaagcatttctagaatcctagaatccaatttaggataatacatgacattttttttccagcagtgtctcatcgaaacagttgaaaaaagttgtttctttagtttgctgaaaatgaatgatgctgctatttacaaccaaggtgtgtgtgtgctttcaacacacctacacatcagtgtgtcttttgtgccatttgtgtctgcatgttaatcagtcaaaatatgttcctgtaggttcagtttgtatttgacaccgtctgaaatgcacacttctgtgaatcagagccccctgaatatgtaacagccatgcaattattgtttcccttttactattctctgcgttacacaagttagtagacaaatgctaaccacacatgaatatcaatcaggtgccataaaagagcagctgcaatgcctcataaatgctttaatcctgttactagtgaaatggccatgacttttctttccttcagcaccaagtcatttcagatgggagaaatgtaaattaatattgctcttagctttcaaacctgtgactgctagtggcgatttttataggagaaaaatgtggggtcaataaaattttatttatatggagataattatggagaggactctttttaagccatcttctcagcataaagtaaatgcataagatcctttccttgatgaaaaagaaatcagcttgaaataaagatattgaaggctttgccacctcttggtgatgtatgactagaagtgagagccctttctgagaacttgccaaggagatgattaaacaggaggagagcatctgaatattgaaaaaaaaaaaaaagagtaaatctcagtgctctccaacttcacccaaatgtgtattttgtgaagcgttctgtttcctgtgatggtttgggattaatgaagtacagtataattaaataattggttaatacagaaagggctgcacaatgaatgcttcagctgaataatttgatggggcattgccaaagttactcatcttgggtaaacaaaatgattaaaatttcccattgattctgtaaacagattagaatagaaaatcaaccttagtactagggttttggggattttatctgctcccaaaccccagtagtaccagtttgccatcactgcaaatcttcctgagcacagagcgaaggggtgaggggaactcaattgcttaactctaggtagatcctggggacagagcaagaatttgcctctgtagatgtgtagtctccctatctgctcagactttttagaaacctaaagttcaggagcgtgtctttccatgtgattaggcagaggtttctttttctaagcctccgcagaacctcttcctgaaatgcattcatttatgagacttgcgagatgatctgcaattgctgcttgaattgggctccctttttgtattcagacaattagctttgtcgagtgagaataaggcacagtctttcccttgtaaagatcaacctgtattacttattaaccctattgttttgctgattattgcccagaaatcgaatttccaaaaaagaaactgaatcattatgtgcaaagtaataaatgactttgagaatctggctacatttaaatgtatttcttttgacaagtctcttaatgcctggtgtctttggtgcacgttgctgggtctgtgtcagtgttaattaaattgagctctttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagaggtaaaaaggcatttcccctcatttaaatgggtttggctattagatttttctaggagaggagggggtcggggggtgagtaaaagggaaccgggctagggcagggaggagggtgtggaggagacgcgaaagaatggggtctgatctcctaccccagtccaaaactgatcgagtgagtcatagaggaagctgattgagggcgtgtgccacatggcaaatgcctggaggaactggcaagggggtgggggcgggtattttttattttcctctatctcctctttggtgacttgctttgtatttcacctaggagttccttttggttccagggaagctccagatttgagcattttcatgctttctctcccataggctcaactttccctgtccccccacccgtgctcacaggccactcacaatgaaaaattccaaatccaaagtatagaaacttttttagggggggttggtgggaggttactatgtttaatatgaaaagtttatggccctcagcctgttttcccttgtaaaaagcacagggagaaacccgatgatgtaatgcaccagaataaggagctggagcggagatggggtgcaaccctctggggtgcttaatgtttattaatcagtgcatgatttgggagggtgttagtgattcatgctgccttttctgtcacatagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgaggtgagtgcagctaagtggctctgtgaggttctcccaggtctccttctttagctgctcgctggataccataagctgctgtgctggcacatcccctggcaggggtggggagaatttctctgcttatgcccattttcatactaagggtttgctatcagtgcttcttggagcaaaaggtaacccaacatactgggcctttgtgtaggtatgggtattggaattggtaactcaaagagtctgagcccttgaaatcattatcctggcataactcaagtttgctccacctgttgcaaatatagcatgcttgacagccagcagtaccagtatgccagtaaagtggcttagaaagagtcatcaagtagtgttgaaaatggatgaaaccctctaatgccctgggaccaattttccagtgtgagagtgattcagcctcctaaagaccccatttgctttttctttcgtcacatcactgttctctagcattttggtgagagaatatggataggctggttaaagggaggcaaagcaaaaaaattaaaaagccactttgccatttcttagcagttctagtggtaacatttgatggttgaggagattgaaactgtcattattgctgaaaatttaagaattagttggctggttgcagtggctcacacctgtaatcccagtactttgagaggccgaggcaggagaatcggttgagcctggaattccagaccagcttgccagcctgggcaatatagtgagacttcgtctctaacaacgaaaaaaaaaaagagtaagaataagaataagaattatctatgcatttgagtgagctctgtttctttctcttcactgggaatgaatgtatttaagtagaattttttttttttttttgagatggagtttctcttgttgtccaggctagagtgcaatggcacaatgttggctcaccgcaacctccacctcccggcttcaagcaattctcctgctccagcctccagagtagctgggattacaggcatgcaccaccacgcccagctaattttgtatttttagtagagacggggtttcaccatgttggtcaggctggtctcaaactcctgactgcaggtgatcctcccacctcagcctcccaaagtgctgggattacaggcatgagccactgcaccgggcttaagtagaaatattttttaaaatgtgatgtggtcagatgtttgctggctattgaaatattttagggcagtagagtggtatatggatgatggctggtgggtggctgggaggaaggctataagtaacatttcttaagttgatttcatttttccatgaattgcttaagtccctctttggttagaaatctgatgcactgggaggcatatgtcctcttccaagctaccagcgaaaagaatactgcatacttagagagcactttcacatctttcaaagcaccttcccaaacattgtttcgtttgatcctcacaatcaggtatcttgataggttgcccttcagtagatgatgaaacagaggtccagagatgctaagggacttactcagactcacaaagctggtcatcaagagagggaggacgagactgaaggactctatactgcctggcaaatgtgatttcagtgacaccttcctgccttaaaagtaattcagcctgacatacccaggctatgatgcatacataaaatggcctcatagtatttgtgtcaattttgtaggataaggggtcttaggaccacttacattgattgcttcttctagttcctgaacaataattcccatcagaattaatggggccaaacagcagtgcttttgatgagtaactgatggtattctgccagcaacaaaagcaccaatattttcaatttataactctataaataaggattttttgaaagtccagtattgtgctaggtaaactcagttataattattaatgtcagtgaatactactaaggcctaggccgtagactacttacaagactacttgtggatcaccaatagctcagcaatagaaagtgagaggtagtggtgtgtagtggaatcagattgatcatgattttgaatccaggaatcactgcttgctgtggaacataagactctgtttctttatctacaaaatgggcacacctgtcatgcaaagttgttccaaggaatatgacttgtgtagtgtagtaggttcaactcattggtgtccccaaaatagtagacctcttcactatacagttggagaatcagtgttacaatggcttgcactactgattgtgtctccctaggcacttgtaaccaaagaggaatttaggctgcttctatatagatacatcctacaaagtattatggccatactactcatattgatcatttaaacaatagaggtgaaagatgccaaagttgtggggttcagttgttcacaagtaacggcactgttacttgtggagatggacaaaagggttgaatcctgaggacttggtgatcacttaggcaatcaattcaaggcactagagaaatgtgagttctggtgtctatgaaatagatggagaggacagaaaacatatgacgacatctgattggtttacctaagacttagtatcatttctgggattcttccatgggctgaatgaaacaaaatattgcttcaattatttagaaaagccgtttaaaatctcagttctgatcctgtctctgactcacaaagccagatgcttttccttggttaacaaaattacacagttttggtgtgtacagctggtcatggccaagacagtgtgtactagacatagtgaggttgtgtgtatttctaatattcagtccctcctggagagttcaactggcaaacccattcagaaaggagagaggcccacttacagctgaatacagaccaggccatttaacctgaatcagtcacaatgccctgcgtagggaaaatgacacttcttttcttttataccaaaggccactggactcggtggaatacttaggtccaatgaaatctatagaagagcagggatgattgatttgttcattcaactgatatttgttgagcctactctttgtaaggcactgctctaggctctggcgttagagagatgaaaaagacaagaaatgcacattctaaagtgtgagacaatcaagtaaataggtgatttgcaatatagagtaataaatgctaatatagggtgcaatgggacattctccattgctaggataataacattttgatatatttcctacattatctttatattttcctaattaattaattaatccattcaagaaagcaacatttattaagcaattatagcatagaatgataagtgctatgatgtggcaaatataagattctatagaaatttctctatattatgttacttacattgttctttatattatttcattaaaccattctttcatttgttcattaatttatcccattagcagttattatacatttagaatgtgccagataatgtactacttcccggggatcaaaaataataaaacacttgtttcttgaacccagggagcttacagaaatacagacaagtaaacaggtaatttcaattcagaataacatcctattcctgagcacgttacattcttactctccaggttgggacaaaagggtactacatagtaggttcctctgttgggttacctgtgtcaaacccagtccctttatgagctgtagatccagttacagggcttactctcaaagggattatagacgagtccactcagacctgttgcgtgctagctgtactcactctatcacactttgaaatttatcaccatggcattagatcaagtcagcaagcattgttggagtatccactatgtgctcagctgtgtggcagggaccatggagattccaaataagtttaagacgtaacttctgccctcagagagttcacagtctagttggggagctaagatcacccacaatgatttcacgggcaagcaatacaagatagtttctgatcacctgtcgctttgtagactcctaagaactcctttctcctcctttaatggcagccttacattttatgtagatttgccattgaaccctcaaaatttagtgctgaatggaagatagctcttgtatcagtgtccaaacctagccacatctgaacattgttggctctagaagctaacagaaatatgactttgaatgcagttaggtaggcaaggtaaagggaatggaacactaatcaagaattggaactcagtttacagtattgcagagataatcttgtgtagaattgtatatcattatttacttgtcctctgatgttggctgggaaatcagctatgtggattttgtggtttcgtacacaaatttgaggggcaaagtggaggatgcctttgctgtttacagaagacttttgtagaattattgatgtcaggtatcttttacatattttaaactgaaaggtgaggtttgcattccttggtatcctggtttattttactcatagacttagtgtatatgtgaatgaattagagggcgtgtgtatgtgtgtgtgtatgtgtgtgtgtgtgtgtatgagggcgtagaaaagagtgaagagagaggaaaggaggttgaaaaagaaggaaaatggagaagaaagatagtaggtttgtcagtttgctaagatctttctaaaaatagtccaaattttttgagaggctccttagtaaggcaaatgatttttcttccggtcttatggaatggagacatgcctactggtgtctctggatgctggaaagtgttattcctttgtacagcagcattgctgcattaccatttttgtcacctggctgcagtcattattggaggaagaaaatgcaactcattgcttctactggaaatggagacttgggtgaggcttcttcttgcctccaggaggggtgaaatggcccaaacacccagtgtctttgtgcagtatttttaaattttagttttctgatgttgaatgtttctgagctgacagctgtaagggagtgatagtaggcaaaaacttagagaattccagtcataggtccgtagggatttaaattttggtttcagtctcaatcttgaattctattttctacctttcatcagcaaactgtagtttctttgatatgaggcatctaaggggtgtgtgtgcatgctctgctatagccactcatgcaacagtcttcataagtagtgacgtagccgtggaagagcttgcagaacaagaatgtgtgtggcagccaaattgaatgcttccaattatcctacaaaaagtctgaatgcatggtcatcttagtggaaataatgaaaataaaacatcagttaggctttgaaaaaaaatagcccagtacactttagttcctaaaacagagttttaaagttagagatttgcagtgacttgaatgaaattctgggctaaattagacagccacaaacctatcaggtagtagattcagaaggcactaaaaaataataggtatgataaggctggtttggatagcatggaaatgacacaaagcatcacctctaattaaaagaaaccaacaaaccctttagtgcgcgtcttgtttgtttgtctccttattacagtagggtcttggaatcatttaagtcctatccctaagggtcaaaagtaaccctgaaggagaaagcaatgagaaacaatgcagcccacatcttttcgagcattctcatttcagttttcttcaaaaatcaagggctcaatttctaccagcagtcattctagggccacccattgcctacattgtatcttattggcatgtttcacctctagctgagacagccggtttcccagtggggatgggcttgcaagatgtgttccagaataaactgttcctctgttgtctccatgcaactgccacagaactgcagaactgagttagtttacattagtatctgctaatttattattatcattccttatcggcaattaactggttaccttagagatcacctctctccccgtacaccttcactgaagttgagctcagccagagctcttgctaatcatcctgagatttttctccccaaggggctggaggcaggacattttccacagagggctctaaggctttggaattcctcttatcagaggaccacttgttttgggtccaggtggctccacctggttttttctctgattgtcagtcagacttacaaggtaggatgagctgcagacctctctctccctaaccttgccccagcttgtgctgtggcttgggcttattgtgcccagcgcagaagctaagggcttaggggattgcttgttaggaattaggggactgaaaaaggatgaagtcacctcctggcaaagctggagtctttcaattgtggcagtgctgtggctcttaggcgtctgcctcgagtttcagatgttggcccctctgcatgtgtacctcagcttccaggatttaggggaggccaagcttggttgaatcgagtgtctcagatttgggtaaataaagccgtttttacaagaggcctgtgtgtgagaggtgggaggatggctctggagcagccattttcccccacggagaagaggcttgatttcttgatgcgtgactggctggcctttgatgtgagcctcatttacttcgaacaattgagaggcttgaagtgaaaatcccagaggatcagttgtttgcagagggaaatgctcttcaagttacatttcctatttggctgttgtgtatttagagtagtttttgtgtgggctgcatagtggggtcactcagcttctagtgggtgtacccaggctgctagcacctccctgtgccccccaggggaatgatgaggaacattcctgcagctgtggggacagcaactctgccaactccgggagcttgagctcctgtgcagaaaccttacttgttatcattaggcatattggttaggaccacacagctccacagcatttctagaagaggtgtcagaatggaccagtgtttccactctacagtaatgaaaatggaaaaggcaaatgacttacccaggcacacaacatttgcggccaaacaagcctccattttgcttcacagtagttcctctggtgcagcttccaagcgttttctgtcacataatgaaaaacctgacaggactctctaggaggacctgcgggtatactttcgatggtagttgtgttcctgaaaagctggtcagccaaagggtgtttgttttgtaaattagaccccatgctaatcacagcagtggaattctgtatttaaagaaagcctgtgatggatcctttcataaaggagagtccttatataatgtgaataatcaactcctaactgatttcttttgtaagtctggattttcacatatcttgtttgcttaaaattagattcctcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtggtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaattagattcctcaaattgacaagatttacaaaacctttgaaaggtgggccaattcatttttcccttgattgaaatctggcccttgaatcctcactggttagccttcctgtttgatttttacttaattaaacaacttgcaactatgtaatatttaaaatatagtgtccagaaaagatgggtacgtgtcattgaaatttaacaagtattagcatttaatatttgcttcagattctaaaaaaatgaaataaaatatgacagctgccatcttcccatccttttctctcctttgtaaataaacccttggctcaaagaacagaagcccatcacgaatttttttttgtcttcacctgtagagctcgttcctgaagagatggcttcccctttgctgtctcagattatgaaagctccccaagtcagtaaggatttcctggattgggtagagcctgggaattactttggaaagtgaaagagctctcttagacttgcctttaaattcagtgtttggggagggagaaaaatcacttttcagaatggggaaaaaatgagaatgagagtgagacagacaaattgacagacacatgttaggtccagctacctacagaattttgagcagaccctttgggactgaagcaggcaggaagcttggtgtcaagtctgtgttctccttgagctcagtgttcatggactagcaccgcggcttctttttgttgttgttgttgagacggagtctcacttcgtcacctaggctgtagtgcagtggtatgatctcggctcactgcaacctctgcctcccgggttcaagcgattctgctgcctcagcctcctgaatagctgggattacaggcatgcaccactatgcccggctaactttttgtatttttagtagagacagggtttcaccgtgttggccagggtggtctcgaactcctgacctcaggtcatccacccgcctctgcctcccaaagtgctgggattacaggcatgagccactacgcctggctgcatcttggcttcttaatgttagatgcttaagcactgtcttgatgtgcatagtcttctgatgctccattaagtctctgagtgccagggtggccagttttcagtttctcccactgggccccatctggccgctgttctgtggcaagctgctctccctcactgccaccagcactggccttggcggtctctgccttctggattattttcgctcccaaatctgatttccagagcatgaagggcacctcttctcagattgtgtagtttgctcttctgagcaaaatggattccctgtgtaagccgacaggaagaaaagttcaatccaaaggccagatccctctttaggggagtttgtgtgtgtgtgtgtgtgtgtgtgtgtgtgtgtgtgtgtatgtatgtatgtgtatgtgtgggagagggagagggggaaaggagagagagaaagaagcaggagggaataaaatgaacattatctgcttctctcactcactttttttgcctctgtgatgatggagcctttgccggctgggctgaccgtacacatgtctatgatattaggtcctcagagcccccttcccaactctttgacattctgctggttgtctccctgaggaaatgctcataagcttagttacagcagggtgtgatcccccaaatgtgaggccatgacaccccaatttgatatagctcaaggatagatctctcagagactctttttaattgagatctcggtgagtaggaagcagccaaataatcattgctgtgcatacaactcagcttaagaataccttatagtgcatattttcaatttattagaaattattttctgaggcttgctttctctttttgtttcttttgggcacaattctgtatcaagctttcctcttctttaattctcttggcttgagggagtctgctatggactgcctatgtgtacaggtcgtttgctataaaaccatatcttttctaagtgagaagaatggacagggagaccctgtcaaactgcattcagagggattggcttaacctttaagaggcttttttataactaaaaatgtccgtaatctagcattcatatttgaaacttgacatgcttgagggaggcagggctctggagatacagggacgaacagaggcatatggctacaggtaatggtgaacggcttgttggaagactgatttcctcctctgttctgccaggcacagaggccatggtaaggacacagacacactgcactcataagactggcattgactatgagcttgctgttctgatcatttctttaattagtgcatttccattttttcaagtatagacttttgagtgatggagtatgctaatggtaacatttgttcctaaaagcttaggggagagaacacagtggcattcgtactaaataatggttttttcgtagtgaagattttgcctgattttaaaattgcaaaataattttatggtagttatggctttttggaaacgaatctcaaatactacatatgaaacaccaattttctgtgtggcttgtgcacttactaatggcatgtgtgtgcttacacttctaggtcattctattttgcctttactggtaattctttagaaatagaaaaagaagtgtgctttgttgcagtaaaaaatataataattttctgaaatggaaagaaagctaacctgcctttgcaaaaactatgcattatgtagtggcctgatggagcaaaaccttataaaactggtaagctataaataccatggcactgggcgttgttggaatgacatccggggcttggtctttgcacatctgatcaccaggtaccctcaagaggagatcatggaaggtggagaaaaatccgtacctgtaaaggtttgtggctatgcatggtgtcatatttggaaatatgggatcaaataaatgtgtgtgatgtttccaacactttgctgtcctcactctttgagcctagcaaactctatcaggacagttttctctagtgtgtgagtgagcccaagtgactgtatcatcaaagataaccatctagaaatctgcagttctgaggtaggggagatcactaccaaaacagatgaaacaattaaaaacctcataaaagagaagctttagtttattgaagcctgttattactagggaaatcagaatccaagacatagagaattctgaaaattccagacaaatgccaaactacaccaaacctgcaacaatatgtgaagagattgggttgggggatctccaagttatctttcagctctgggtgtaaatgtgtgaatgtttgcagcattggtttgaagggcttcatatagctgcctgcattgaagtttgagtccatgtgatgacaatggttgctctgtaggtggtattgaaggcagaggacttagctatggcaggtgaaacaataggtacagcacattagcttttaatgagggcagcatattctgtgtataatctgagttgtgagtgtgcatgccaaaactcagagcctctctgttcaaatatgtcttcctgtccaacgcgagttctgccataaaggcagcaatgggtattctaaccttgcttcatttggtttgtacttgttctagggatgaataggagatgcacgcgtcttgcctggcaaactagacctttcaggagagcacaaattcacttaaacataaattatgttgattatcactctacctaaaaatttatagagctggaagtcaccgagatctccttttaagttgggtattcttgaaaactgttttgtatatcatgataaattatctaaccttttatacagttgaaggccaacattatggaaataagcagctttttattccattctaaggtcagtctaaccaaattatgcaacttctaatgcagttgcttgaagcttccactttgaaagttttttcattttaataccttgcaacagagataaatattttagctactattcatgcttaacaatatatttcactgattgtcattctctttgtgggatttgttggcgtgagaggcagtccaccatgcctctgctcattttgatgtttgttataggttatcagaaaagagccagaattcaataaaaaatgtatttttgttcttgctgttatttttaatttcaggccataggaggctgactgagccctacagaatcaatatatacttggcacttggggtttgacttaagagccaaaaatgtggtagattttcttttaaactagatttgattccagaattattaaacccaatgcatgttggaggctgatggactgcatccagcaggatttggggcactttctgtaacaaagcaatttatttctttcagggagtcactgctacttcaggggaaggtgcagtcggtggggacgcccttggaagttctgttctatcctaggctccctaaacaataatttgtaggagctccttgatggtaggatcaactctatgcagtttcttttggatagtgtcaggtgtttattaaatgtattttgttactgatgactagctctatagtggttatagtgccctgctgttagagagtattcatttattctgggtcaaaccttgccctctatgatgatttgcctccagactttagtgaatggacttactgtttagtagttaggctctttaaaaaaatattttggcttgaaaatatccactcattcatccatccaccaaatatttatagatcatccttcactgaccaggcctgtattcagcccagagagacatagagaaagcataagtagtacctcaccttgtagtttatattgccactgaggagacaagatagaagttaagcacattttctttaagtcaatgagaaaagcagagatcatttactaaatggtgccatgtaattggttaacaattggaaaaaatatgatttatttcccactatatgacaaaaataaatttcacatttattaaagagttaatatgaaaactcaaataataaaatcattagaagaaaatataaataaatatccaattgattttgaagctgaagaggacttcaagagcataaaaacaatgaaaatgagcacaaagaaaaataccagcagctctgactatataaaatttaggaatgtctatatatctacaagtatcataaactaaattaaaaaataagccataagctgggaaaatattttaaatttatagcgcagagaacctatatttattaatttgtttttcagctttattgggagtgtaattgacaagtaggaattgtgtatatttaagatgtacaacttgatgttttgactcatgtatacattgtgaaatgattgccaccatcaaactaattaacatagcctttacctcatatagttaccattttttaaaatggtgagaacacttaagatctactctcctagaaaatttcaggaatacaatacagtattgttaattatagtcaccatgctagacattaaatctccagaacttatcttgtataactgaaactttgtatcctttggccaatatcttcctatttcccccacccacaacccctggcaaccaccgttctgttctccttctatgaagaacctgtgcttattaattcattaattaatgcttcaattatttatagagtgcttaccacatgttagtcactattcaaggtgctagggatacaacagtgaacaaaaatctctgtctccattgagtttacatttttatggacagatggtgatacgaagaaaaataaggaagtatgaagcatacatgttttgtcgagaatgaggattgctctaggaaggtcagggaagacatctcaaataagaggacttttaaacaatacccttatatataaagagctcttacaaaacaatgaaaagacaaacaccccaatataaaaaatgtaaaatgaacacaaatgggtaattaataaagaagccattcaaatggccaatagatatataaaaatatttcaaccatagtaatcaaataatagcaatgaactgctattaatttttaattgcaaagatgatgcctacttactactaaaaagtcaaggaacacaggaatgtgtaaaacaaaagttaaagtctccacaactatttcctcaccaatctgttacctcaggggaatcacagacaacgatttgatatgtaagatgtcattttgtacttatcaaataagcaaagattaaaaaaaaaacagtgatggcaagagtgtggttatgatacactgcaacatggagtataatttaaaaaattgatataatctttcctgggggcaatttggcaatacacattaaaagccctaagatatctaatatttctacttctggaatttatcctaaggaaataattttagatcagcgtaaaaattcatgtacagggttgttaatctcagtataatttatgaggataaaacatcggaaatatcctaaatatcatcaatatgttaatagctaaatatattatgatatatacatatgctagaatactgtgaagccagtagaatgttttgaggaatacttaattacacatgaaaatatggtataatatacattaattgaaaaaatcagaaaataacacacatagattaattccagtttaatgtatgcatatattattccaattgtttaactataatacaatatataaatatatataatatataaacaattccaattgtgtgtatatatatgtgcgtgtatgtgtgtgtgtacatatatatattcatacacacacatacacatgcacatatgcacacacataagactagaaagaaaattaccaaagcattaacagttatctcaggttgtaggaagtcaggcaatttttactttttaaatggtatacttttttaattttccaaattttctgcattgaacatgtgttatttttgacatcagaaaagcaattacttaaattaaccgtaatactatgcagtaggtattaagggccaaaaaggtggcatagacagtttttaatgagttattccgaggaggggcagaccaaaatgttccttattttcattttccaattagatcataccaattttttcttcttaattttcttctcttggaggtctctctcagaaggtaacaagtatgaagttttacattttaaaataactattttatttacagtttaccttttaaatgtgagaaatgttatgaacaatatttgtttcctttttcattctttttgtccttgtgtatactcttgtaaaagtagatttgatttgtctcaccagtgttagacatctagttcacatactttatttttagaatgagaggttttaaaatagtaaaatttaactgcaacttatacatatatttaatactatagaaatgatataggctttatctaagggccacttttggcaaaatatatttttttcagtgcccttttcagtaccaaatggccaatttggagggaagtgcttttttagtattctccaatacttgatttcatgttcttgcttctcggctctgaagcatcctgtttcaacatgatagccccaaccatgtggaacacaaaaaagaaggagtcaatgatttggtggtcattgagatgctaaaaattttaaattcaaccttgactaaatgcactatttgtgttcttttttcaacaaattagaatgggttcaatccttttctgaaaggcagatttatttgattgcttcctcatctagtaacctagttttggacagcataaatacaaaagccaacatcctttggaacacctctttaattgatggctgtataaacttctcacatcctaagcagcacagttaagggcaaaatatttaattcagtggtcctgtgtagatagacatcagaactacttagatattgtaaagaaaattctcatggaaaaaaaactcacacagatgcttcactctccaccccatagccaatgcatgagaaccctgtacaacatcactctgattgtgaatgaaatctttgctacaggaaagtgtctgtggcctaattctgtagtctgtcccttggataaatggagactatgactttcagcaggactatatatttcttatatgtgcaaccatttaactagatgggtttaaatttgaattataaggttttcatgttacagcatggagcatttgatagaaagaaatatcttgattttttcatgtgagtgggcatgaaagaagggtctaaaaattgagggacctcccaccccagcctcctttgtagttcagttccttaaagtaaaagtcttcatttaaagaagtattgagaatgtttgaaacttgattatggagcaacttaagattcatattttctcttcagatggcttaaagttgagattgtttggattagaaaagaatttccatgaaattaaaatatttaattgcagttaagccaggatttggaaaaagttaatgtgataaagcagagtgttctagctgaaaaaaatttatgtaatattatgtaaattcatatcagcatgaaagttaatataaaaccccagaaggtgataagaagatcgaaagcaaggaattttgtttattgaattcaaattctatttacacttgccaatcagtgagggttttggactggctgtgaagagagccctactaagcacacgatgctttattcgatgtgtgtgaaggcctgactctgaacttgcttatgggccccagacagaccaaaaggccttgaggtacccttagctcccaccctccacttcctatggctgctgttcgctaggtcccaagaacagaactgatgggatgatgtgactgaaatgtttttatttaccagtgccgatgagggagatagaaccatgtagggagatatagatacacaaaagctccctgcaaccaatactaatctcaatgagttggtatttttgaaaacacatatattaatgtcatgactaaataaatgcccaataaatgtttgttgaattaatgagaaaaacatccatggttttaatgttttaaaattttagttgagatcattctatttctcttttctcatctttacattatgttataagattttttctttttttttgagatggagtctcactctgtcacccaggctggagtacagtggctcgatctcggctcactgcaaactctgcctcccaggttcaaaagttcctcctgcctcagcctcccaagtatctgggagtacaggtgcctgctaccatacctggctaatttttgtatttttagtgagacggggtttcgccatgttggccaggttggtctcgaacacctgacctcaagtgatccgcctgcctcggcctcccaaagtgctgggattacaggcatgagccaccatgcccagctaacatttttttctatgtcattagagaatatttataagcaattttttagtggctgaattgtattctgttctacagatagggtttagttttactcaaacaatcgctagcattgaactttgaggttatttaaatttttgttttatataaataacaccatgatggctatccttatatataaattttgttgtgatctctgattgtttgcctgtaataagttctctacaagtgaaattgttttatctgagggtttatatatttttaaaagtggtatttcccccagataagttgtagcaatgtgtactcccactgacagtgtatgaaagcccatttcactgtactggcaaaacattattatagttttaaacgtcaccaccaccaatctggtgaagctgtgggaaaacaggcagtcccatgcattattggtgggagtataattttttttttttttttttttggagacagagtctcactctgtcgcccaggtctgagtgcagtggtgtcatctccattcactgcaacctccaccttccaggttcaagcgattctcctgcctcagcctcccaagtagctgggattacaggtgctcaccacaacgcctggctaatttttgtatttttagtagagacaggttttcaccctgttggccaggctggtcatgaactcctgacctcaggtaacctgcctatctccaccttccgaagagctgggattacaggcgtgagccaccgggcccggcctgggagtataaattagtaccagtcccatagagggcaatttgacaatatctctcaaaattacaaatgcatgtacactttgacccagcaattccacttttagggatttaatcttatagatatgcttgaccacatgaaaaatgatgtatatacaaggttcttcattgatgtattacatgaaatagcaacaatggaaacaatgtgtatgtctgtcagtggaaagttttttttaaaggagtgttttatatattgatatggaaaatctctaaatatattgttaactaaataaaaggaagattcaaaaaaaagcgtagggcacactattatttctgtgaaaaagggagggaaaaagagaatatatatcttattggtttatatatacatgaaattgtatggaagaataaataggaaattaattagaatggagacctgttgggagaatggccaataagaggataggggacaggggtgggaaggagaattattagtttcatagatggaaaatgagtatctaattttagtggaaatttgtatttctttgattactaatatatatattaaggtaaatccctggtttaatttattggaaatacttttcttcagtttgttgaatgacttttaatttgttatgcttatttttgacatagtgttttggaatcatatgaaaaaacaatttgtcagtgctttaatctgcgatttcttctgttgcttttaagctattcaactttctaccaacaaagagactatatatataatatttcttccagtatttttatgaattcacttttacattacattttaaattcattaggaatttattttgacatatagttggaagtatgatgtaaaaaacattttcctagatggttaattggttgagtttgtaccatttattgtttatttcttcttcttcaccgtaactttctggtgcttctgaaaaacatgttgagtttttatagagactaggccctttcctgggctattcatttattttccactgatctgtttgtctactataccaataccacactgatttgattattgatactttataatagattttaatagatagtaggtttagtttctccttattctttgtctttaaaaagagtttcaatttttctgtttattgtttcagatgaactttggagtcatgttaagtctcaaaaatgattatgttgggattttgattgaaaatgtaccaaactgataaatttaggaacaattgacatgtatataatatttagtctttttatctagaaatatgacatctttccatttagtcatgtttcattctaatgtcatcagtatatttacatagttctccttacattttttgttaagattacttctggctatttaatggtttcactgttattttgagtgggctctttattccattacattttctaatcaggcaaagctggcagagtacatacgagagctcttgacttttgcatctctatttcgtatggagcgctccatgttttcttagatacggtttgtcacttgagtgttcatgtaatagttattttgatttattgcatctttgcttttagaagttagagtcaggagccaagtggctttagggaaattacttcctctctgtgcctcagctttcttatctgtaaaataagagtaatgggacctacctcgtagattcttgtgaggattcaatgtgagtgttcaagcacctggcacataataagccatcagtaaatgttaagtagctattactattatgatctctttttgactaggaaaatatctaatttgtgcctcttaatctggaaggaggcaatcagattcttactgcctctagcaatgtactgtagagggcaacacaattgaattttgaaattaaagaaaactttcatttgcctctattctgttactgcaaacaaattccacctcagtgtgcttttctgcttttagttacacaaattcctttttacatcacagtattcttttccttagtggctccttcagagtttctcattgttccttactgtgacacccatctctagttcaaatgtgaagtgggaggaggtcctacgtgaatcagagttagctagatgtgctggccagagagccagaagccctcttctgatgttatcccttagtattttctttccagagtcagtggatatcaatttaggccttaatctggcatttttcaacctttctcctgcatgactctgtgctgggtatctccattagctaggaagctctggagatggcaatttcatggaccactggcttggggttgtgacctgcactttaataaatactaccccaagcctttcttatcctgtgacctgctgcttccgcagacctgggctctgtttcagggccactgccttttcttctttctttcatgcaagtgacttacaaatgaattttaaatagccagttcatggtgaggaacttttgagatcatgttcccaggactatgctctgtctcagacatgttttacttctacccaggaaaccagcttcttgtatctcttatccaagaatattttatactcttttctcaattttggggtgaagtgtagtggcctagggcagggactccaatttcactttggcaacttgtggaacaatttatgcttgtggggggttttaaggaagtgctaggtggcttggggagggggagaacaaaagcttggttatctgttataatatttaacctgaatgtgaaatgtgtgaactctgccaaacagagtctcactgtaagtgaagcattgccaagaaaataataggtaggtggttgtgtctatttctttttttttttttaaattactggatattgttcccaatagtcagcagttgagtactaaccattttctgttcatttcagtacaggctgattattttccttctctagcttatagagttgtaatccatgcacgtataattaaaatgatatccaaatgcagttttcctttgaatttgtagtggctgtgtgtgtagggaaggttgttgctttgctataaaccacagacccagagtaaacctcagctgtgctgcagctattttggacgacagctttctagttgcttgtgtgtaattgcccatattacatcatcccaaccattgtgaaatgtgcaaaatacaaggcttatctaatgattcatttcaggtggacagtttcttttaaattaattttaggagtggttctctgcactaaacagatctccctactttgttcttgcttttttgttcaggcctacggtaatttaatggttgataattgatgtagcagagagaagtgtatcatattcattgtgccagtaacctttacagtctacctaaaatgttccatgggatgtgctttctcttggcgtaagtaaagaaccaaggggagaaaaattccctccacagcatatcaagtaagcattaacctcaaatgaaattaatttccctgtcattgagtagcagagaaaaaagctatcttcaacggctacaagaggcttggtcttactggggtttcagtttgtcatattatactgtctttcattatcacagacatatactatagggaagactttcaatgtctctgttggtggattgcactaactcatctttaagtcaggtatgtgaaattcaagtaagccaagaccttccagtttttttcttatcaatgttgaacattcataggctaggtaatattacatgtttagtcacctactagtaagatgaggtgtttacaactaatatttatctttggccttggaccttctacgttgctcacagagtacagttttgtaaaatgctttataggtaatatttcaaagtggacaaaaaaagaagattgcttagaaccagaaaggtcagaaatagatcaaataatcctgggactttttattgctgaataatggactttgtaaatatcacatgtgactattagaccaaatgagactacatagaattcaatattaattggttcagtatccgctgatggcctgtttgcaggattcaatgaaattatattatcaatacaatgttttattgattccttggtttgcaaaattaaataaacatagcgtaagcacttgcagtggtaagttgtagcagggaaacgggttttgatttggaatttgaaaacaaaattaaaggtgattgaagcagaaagcaggctgtggcataacatttctgccagcacttttgaagtaactgaatatatctgggtgtttgggaggaataagaatcagagaacagagactttggaggaagtgtttcaaaatgctttcttaagggttatttcaatactagcaactcattttgttgaatagtttagtttgctttactatggatatattaatttatttcattctatgctatttttttccagtatctatgccattctttgtgttgttctagataatggctaaatagtggtcagcaaaactgacatagtcccctgccttcatggggtggggggacaaaacaccaacaatataaaattataatgctatgaaagaaaagagcatattattatgaaagagtaaaatggggaaactcaacctagtctgggggaagggaagtaatatttgagctgacccttgaagggtgagcaggagctgtgaggcaaaaaggtgggggacaggaagatggttgacggctggctgttgacattaaactcttggcctaatctcagggaaccatttcccacccctcccccaccaaggtggtctgaatttgagtgccaaagtcttgaatccaacacacagccattcgttaaaaaagtggaaagaggctgaggcaggaggtggtggttgtggtaacacacagagtctaccatgaattctgaaaaaatcaaattcatttcagaaaagcagccatgaaaagaatctgtttcaaagtaaagaaagaagcagcctgcagccagcttcagatggatggtttgtggctcaaatccattcctccagttactgctcgatggcccttttgagtccatgccacctcccacccccaaccaatgtcaatgggtggtgtgcagatgcagctcagtaagatagtgttttagggcatgcaaggctcatctagtcacatttataacatagaatcagagtactgtcaaggcaatatttatcattttatattctttcttggctactcttgataaataggaggtcaagggcctcttcctctttatattccctctggataaacagacagcagtctccagagaagaaaggcgtctttccttccctattttctgcttccaatctgtttctttttccctctttctgctccaactttttttctgtgacgttctgtctgacagtcagcagagggcgtatagacgcatcaaaagccagcctttattcaacttggccaccgtaatttcattgtctttatctcttcatctttacattcctcaaaggcagggatacatcctggcgttttctctttgtaatagtaccatcaagggcaaccattccttacctattttataaaggtgggcaaaagctactgtctagataaagggaaagaagttgtgttcctgagagctgggaggaaatgtgtgtgtgtgtgtgtgtgtgtgtgtgtgtgtgtgtgtgtgtgtatgtgacagatctcagagttgttggtgccctacgtgactcatttgggaaggactcgttttgccaatagcaaagcagacagtctgggttcctcttcttctttgctttcccggggctgttgtcctgatagcagctgccctgcttcctgacatgtcctaataatgaagatgatgtggccagggggagattcatcttcttccctaatctgacttcttcattgaattttccccttactgaagtccaaagaggattgtcccctcttaactgtgtgccctttttactctgcccaaggtcagagaatccagctgtggcctgtctgcctcccacatctctggctgcagagagtgatccatgtttgtctgtgacagctgtgtgaatggtacgtgagaggcagaggagagctgtagtttaagctgctccaaagatgtcttggtatggcagtgctgacgaaaggggagacttgtttgtgtcgatgacataatcagagaagacatccatggcccagctgcagggagtgaagaagtgtgcagcttagtatagtcttctgacaaaagcccacacacttcaggtttatctgcccgtagtgctaatctccttctgatgtcttaacctgacttttgttgtagtttgttcagacggttccagtgacagaaagaattgcttggcttgtggtggttatactggctagcacgttaatacaagtgcagggtgttttataaccaactagtctcataataactacacatgaagaacaggcaaggtttagtttagcatattctgcctattggaaagcatcagacacggttatagctcctcataaataatactgatggctcctaaaggccatttttcatgtaaatttccttactgttagtgagcttgaaaaagaaccgtattgacgaacaggttattttaaaagtagaatgattactcaataaaatacttttcagctttttcctttggggctctggggttcccccttatctcaaggatccacgtgggcagattgcatgttagctggagaacccaatagacacattcttatttccatgccagcaaaacactaataatctaaacacaaaggacatttaacacagtaactgtttctgatggagcaagtggtactgccagctcgctttctcttggatggcttctgtacggtgagagcaggattgggagttgagcccaggctactccttagtttgtgtggtataaatgaacaacttaagaatagtgtttgtatagtcagggtcatttctgccctttctcaatggacttgaaatcctgggctgaatatttatccagcttggttttgtgtttttggaacaaaggaaatttccagtgaccagtctggttaatcaccaacgcttattccctcttcaccactatttcgtattggatttccttctataccagtacattggatttccaatcacatcgaaccctatttggctgccttccattcacagaagattagattcccttacacctcactgcctctcaggatttttctctccacaacgtgtagagtattaggttcccttacatgagttgctgcttgttaagttgtgttcagtgctgcgtagtatcgaattctctttctcatcagcagtcactgggttgttaattacacacttgcagattcacttctcctgcacatgctgtgacacacagctctccaaagctctgaactcacacttcaatgccttagccatatctgcccagattcagtttacttcagctgtgtggtattgaacacctatgcatcagtctgggctagatactgcggagtttacaaaaatgagtgctgaataatccttgccctcaaagagtttacaatctactggggtggatccagggcagggcagtgcataagatgaagaattatgtgcgtgaaggttaagtattggttttactcttttcctagaaacagtttagtatctggcgtatttaaagcaccttagaaggcaacatgttcatcataatgccattattgccaccattctgttccataatgggaagaaaacattaaaaacacaattgtgtgaaaaaaaacccttttaccaggttccaatgcagttattggtagagttggtagaaaactcttaggtctcttaacaaactcttttaacagccctgccttcatacagacttaagacagtattagaaatcatataattctaagagacataaattaggcatagagaaataaacattgctatgtagactgtgctctaacatgccttgacattacttgcaaactaggatctatctctgttgtatttcttttggtaccaaaatactgtgcaattttattcacccctggaaagagagggaaccaaaagtaatacaaagtggagcaagtcatggtttcccacaagcaacagaaagtggagaaggcattaccagttgtgattttattgctcagcattctcaacttcattgcaaattcacaatctagtgtctcacaatggtgtaaatattgcctaataccttcttcatgtagcttctcattccttgaatgcttaacatgtgccaggcactgttccagatgctttactgtagaatcccagttattgctcatcataaatgaatcttctctgcatttgctgtagataaagaaaaaaatctaagttactggcaacaaagggatgtgtttttatccctttctgccaattcaaccagagcacttcattaatgccaaatttctaatttgatgtgaacagcactcctagcatagtctgaagcttgaaatgacagtgatttaaaaagaaaatagtttagaaaaagacctagctaataagaaaagctatttgctataggaattcagtaaaaacccaagctttggtttaagttttttctttaacaataaaatattgtgtcattttaaaaaaaatccctggaaggaagggaaccaaaagtaagtcaaagtggaaagaggtcacaggaccaatgcttttgctgtctacccaatcttttctaactactcatatgtattgtgtgtctaaaattcagagtatgatatctgtcttttcttttttcttttcttttctttttttttttttttttttgagacggagtttcactcttgttgcccaggctggagtgcaatggcgtgatctcggctcactgcaacctccacctcctgggttcaagcgattcacctgcctcagccgcccaagtagctgggattacaggcatgtaccaccatgcccagctaattttgtaatttagtagagacggggtttccccatgttggtcaggctggtctcagactcctgacctcaggtgatccacccaccttagcctcccaaagggctgggattacaggcatgagtcactgcacctggccgatatctgtattttctaacctaattgtgtagcataaagagactttattagtatggaaaagtgacagcaacatttagaactcatttttcaaaggtgtgttactattcaaagcctttggaccatagcaccatttcattagaataatagcatgttgatcctcaattgaaatgccctactttcttgtccatggttatcaccagtagtcagggaggttttcttttccgaggcttgtctttaatcatatagggcttgggactgtactagttcaaccactgtggaagacattgtggcgattcctcaaggatctagaactagaaatatcatttgacctagccatcccattactgggtatatacccaaaggattataaatcatgctgctataaagacacatgtacaggtatgtttattgcggcacgattcacaatagcaaagacttggaaccaacccaaatgtccatcaatgatagactggataaagaaaatgtggcacatatacacaatggaatactatgcagccataaaaaggatgagttaatgtcctttgtagggacatggatgaagctggaaaccatcattctcagcaaactatcgcaaggacacaaaaccaaacaccacatgttctcactcaggtgggaattgaacaatgagaacacttggacacaggaaggggaacatcacacacctgggcctgtcttggggtggagggagggggtatatctaatgtaaatgacgagttaataggtgcagcacaccaacatggcacgtgtatacatatgtaacctgcacgttgtgcacatgtaccctagaacttaaagtataataaaaaaataagaaaaaaatcatatagggcttaatatgaacatctagacacagactttattcttccctaatgctgtccccaaacctttctggagctcctgctatgtgtaatgtagcatgttcctaccttcacaaacattcctgccagggcatgtacttccatagctcaaatatttcatttttttttctttttttttgagatggaatcttgctctgtcgcctgggctggagtgcaaaggcatgatctcggctcactgcaagctccgcctcccaggtgtatgccattctcctgcctcagcctcccgggtagctgggactacaggcgcccaccaccatgcccggctatttttttgtatttttagtagagacggggtttcactgtgttagccaggatggtctcgatctcctgaccttgtgatccgccagcctcggcctcccaaattgctgggattacaggcgtgagccactgcgcttggccaaatatttcatatttcatcttcttttgaatccaagacttgtaagcataatttatggatgatggcttcagagaaacaatgagttacaatgtatcttatgattccttggacatgccttatttaatggtaaagtttccattttccccctgttgctcatttttagctataaagaccataatgccagtcactgcctgaaatctagccaccccctttcacattaatattaatagcataatggcaaacattctgtacattgcctgtgactcacataatcaccatgcaaaatgcatcattcataaattgtttagtgcgacctttggcacagtagcactaattattattatcacagaagcccagtaaactagactggtaattatcagggatttatttgaatggacagctaagctattcttggcaagttagtcaaagcagttgtcatgacagccatacaaatatgtcttatgaattgggttaattagggtaattaataactgttatttgttccccttttcccaagatattgcctcagcattatcaaaagggtgaggggtgtaaactttaaaataatgcttgaatccttctgctaagaaagctactgacgaaatcaatgaaagctacctaccttccaaaggtgctcccttagagaaaccctcatttttatgggaccttctcctacttttggatgtttcagagtcagcaagcacaagccatactgaaaaaaagtagttaaaaagagaagctaaatagtcagttccccgaggctgctgctttccttttagtcacctgtgagaactcccaagagaccatccctctggcttctacttttagcagagccctgctttgttttttgctcatctagaactttcttgccttgctctgcagcctgttcattgtataatttttttttcttatttttccctcacaaggaaattctgagtttttctcacccacatttctgcccctctgaggttttccaagttttaattttgttggaggccttttttaatttaatgccttagggaccatctaacattgcctgatggtggttttgctcttttttcgaagaaaggaaaataggctagctctgaagagctttctctttctcttccttaaaaaagtaaaggataaaagtccaagtttcttctctctgcatcacagcatattaagttgtttttcttattctagtgcaaagaagagagaaagggagaggttaaaaactgaagctgattcttttccccaatgagatgattctttctttcagagtaaatgttgttcacaaaaggactttaagactttttgtgatggttttgaacagcaaatcaatttctctccatttcctgcataaaactaggagaaggaggctgggggaggtggctcacgcctataatcccgagggaggctgaggggggcagatcacaaggtcaagagatcgagaccatcctggccaacatggtgaaaccccgtctctactaaaaatacaaaaattagctgggcgtggtggcacgcgcctgtagtcccagttacttgggaggctgaggcaggagaattgcttgaaccccggaggcggaggttgcagtgagctgaggttgtgccactgcactccagcctggcgacagagcaagactccatcaaaacaaaaacaaaaacagaagagaagggacacaaggcagaaagagaactgaggatgttaattaaacatctaatctatgtcagtttctgggctcagtacttttcatatattaactaatcctcccaacaactctttgagactggaaacattattatcctagctttacaggtaaataaactaaattatatgaaagttaagtatttttctgagatcacacataaacaggacttgaacctcaagtctctgatccagagtctcctttcttctacaccagctagaacagagtttccccaaaaaagcaagaggcttttagtacttcatgaattccagatgccttgctcacgccacaaatttctattgaatataaatgcccatttattttgtttgtttcaatgcctgttcagcaattgagatttctaggtcagtgccagcattctggctgacccataaaattcaagtttgggaggaattctggtaaaatgcttttagcagagggtgttagattaataggttagaaaaagtgccaactttcttcccatgtcatactggaatctcatgatcagaaggtagcttcctctattttactttcagttgccctgttagggaagaaaggctttctattgcagaagtggcttggtggtgcttggaagctgcacaggatatatggaagatggagtggtttagggttctccaggtgtccctgtcctactaagtcagagatcaggatcaggttctgacatcttaggaagctgaaaactgacacacagagacccatttcttttttctttttttctgaggtggagtcttgctctgtcacccaggttggagtgcagtggtgtgatcttggctcactgagcctccacctcctgggttcaagggattctcccatctcagcctctcaagcagctgggattacaggcgtgcgccaccactcctggctaatttttgtgtttttagtagagatgaggtttcaccatactggccgggctggtcttgaactcctgacctcaagtgatccatccgccttggcatcccagtgtgctgggattacaggtgtgagccactgtgcctggcctccatttcttgatatgttattattaaatgggccatggtatcatatatttagtatttttaagttttgtgtgggtgtgtgtgtgtgtgtgtgtgtgtgtgtgtgtgtatagtcatttgtctcgtccatgaaggaccttcattcacttgataaacactttgtgccaggagctgttttcagggttccaggaacagcagtaaactaaacagacaaaaaattcctaacatcatggagttaacattctagcaggggaagagagataataaacaaaataaatatgtgaaatgtatggtattttagaagataagtgatatggagaaaaataaggcagaaaaggaagataatgagttttggagaaaatttgcaaatttaaatagggtggttaggtaaggcttcaatgaggcctaattttatttcttaccacttcacacacaaactttcttctccagcaaagcagatggttcattcattcattaatgcctactctacctacctttatatcctaccaggtatagaatacacatttaaggacaaaacacacttgcccctacccttttggagcccaaagtacaggagatagacgttgaaaaaaataattacacagataattacttgcaattgtgataagtgtgatggaagtagtagaaagtactaacacatactacatatggaggccaatacacagctactaattgtattaagctaaaagccacagatggaccaccaaacatttggtatccctggattctagtaggaaggaccacgatgacatgattacaaagccacaagtctcatttggtttaacctgtgtctagggatctgtgaatttgtgatttcaaatgtttgattgccataattttattagaaaccttcagcctccaacctaggcaattactggcatttgagtttaaacacatgcatacacacacacccacacacacacacacacacacacacacacacatgcacacacactgttgtattctttggaaaacaaatgaccttttgatttggtgtattgtggaactgctagaaaactggcttagaaggagggaaaatgttaatgaaggtaatggctgatttttagagcagagtacctatttgttttttcttgtcctttcattgtgcctccaaagcttcaaaacctcctaaaaatgaaagattataggaaaaaatgcatcttttactttttaaatggtagacagcaaagtattttaatgaggaaatatattatattattctcctacaaaccaagggctaatagtctggaactggtactttggctgcataaaaagtccagcaagacaagccaattatggactctgaaacatttttatttttagttccttgtaatagcgattcattctctgctatggtacattaactgggaaacaagttgaaatgagagttttggcaactttagaataattgactatatttaccaaattcttaatcgtgcagagaggttagcaggggaggggcatagaagaacaaaagattaggtcagggaaaaatacgtctaggagagtctgactttcaataaaggctaaatagacagctttagaatacagttttagagaactcttttttcctttcagtttattcttcaagtagacaacagtttggttatttgtgctgatttctgcctttatgtatgatgtggtgttacttttgtgagcagaagtaattagttgtttacaaatgaagaatgcagtaggcacagctgtgatattcttttccctaccacgagatctggtagtccccaaatttccctctacatctgtgtgcattggtaacactgttaactgctctgttccctttcttttccagtagaatttcttttgtttgggatgactgttacttttccttttggtcctcttttccttcagtggctctgcttgcctatctggtggtcgttttggaagttccaacccagcaccaatccagagtggagctggtgatgccgaaatggaaggagtgtttgggaagggtagatatgttatgagggaatcacgttgaagttaaatgaaccgctaaaacaaatgtaatcttaggcctcattaaggaggtatagttttctgattataagaggtattagtccctctgaattctttgctgttaagactacatctggataatgatgtctgattctggatgccttattttatgtgaaacactgacacactagaatgagcttcaagggaggttaagagactgataaacggcctggagaccacatcacttgtggaacaatgttcatactgcttaattatgagagaggcaaaaagttgtatgaagccaaccttaacattgatctgcagtaggcaaatgtgttgaaatgaagagactaaaactaaactttcacaaaagcatgacacattcttcttagtgtttggcttgttaattagttacgttgagtacaaatatttatagtatttgagtctaggaccagctaactgaccagcacaacagctttcacatactcagcaagggcaattcgttcttaggtataaggccaaagactgacccttgggtgatcatggagatttcccttccctttgtagagtgctctgtatttaatcttctaatcattaaaaaacagatgctcaccactgacagaggtggggttcctagaaaagatggactgatggctgttatgctgtcttccatcttcttgagacccttagcagctttgtagtggtatgctttagtggggttaggaaggagttaatatcttggaaaaaccttggatgtggcttgatttcctcttaggaatattgagaagatgaacacatagtgggaaatttttaaatttactggtgctacaggcttttttccaaaaggcatttgtagtagtaataataatagtaataataatatgcccaaatgacagaagaaatattaacttctgaaaataaaatttcaaaaggcaaattttataatatggttgaccaccttattctttttagatcacctagggagaggtcattcatacctttatttattaattctctatcttctcatgccttattgatttacttttccaaagcacagcagaggaaactttggggggaagagataaaagtaatccctgtttgcacagcaacacaatgtgtacattgttggcttaaggcctgtggtggacagaaagactctggccttagagtccttcaggccctcttatccaggaagagaagacacagaaacatcgttctcagagtagagacagtgtttctgagcgacccaagatttctcgtttcttcttgtgaccttcttcctcttttgggcactgaatggggtcaggcctctagggatggcacacagttagttggtgagagacaggaagggactcagggtccagcagctcctggaagggagaaaggtgacccagtaacttttcagcttcttttggagaaaaggcacagtgtcaagcaatcaggagaggaagaaaacaagcataaaatccacatccttaaagtccataaatggtgaaaggaaagctctctctgctccccaccaagtgtggaagttttatggtgtattctctattcatagggctgacagagagtgggactgacctgctcaggaaggtgaaggtctccacctacaggctgctgcaggaaagagctcagtctgcctttcctatccttgacaaggggagtagagccagttttcagaggctatccaagctagggttgacttgtctcaggactcatctttatgcaaagtctgcaaaaagaatttgaaattcatgaacatctgaccactggagaaaacctttactggctcaaaaaataagtctctgtggtttaattagctaccccttcggatattgatttttctagcacttgtacagaatgtaactcatcttccaaactttacggaagagccaacccaaatccagctggatttgtggctgtagagaagttgcttgattttattaagcatggcttacgttctgtctttctctctcccctgacatttatatgtaacttgcaaaatccaaaatcacagctagagagaagcaaactcttcccccaaaccaaatattttccctaggtctatcccccttagatcatatagtctgagggcacttctgatggcatgtgttacccatggaggctttcttctctgttgctctctcctccgtgctcccatggcacactgtatataccacttgctatggcctaaatgttggtgttccccacaaatttatatgttggggacctaagacccaatgtgatagtattaaaaggtggagcctttaagaggtgattaagtcatgagggttccacccttatgaatgggattattggccctgcaaaatggctccagggaaccaaccagcacctttttgtccttccatcttctgtcttgtgaggacacagtgttcctcccgtccagagaaagatacagcaacaaggtaacatcttggaagcagagagcagctctcatcagacaccaaatctattgataccttgatctgggacttcccagcctccagaactgtgataaataaatttcctttctttataaatttcctagtctcaggtattttgttatagtagcacaaatagactgagataccactatggtagcacttacaaccctgcattataattgtctctccatttaactgtccccagcactagaaatgtgaactccttgagggcaggagtggaatcgggttaatctccagatccctagcgtctcccatggggcctgacacatagtcttaacagtatttgttgaattgaattaaattatttcagccctgagctgtacaagctgtcatttgttctgcaacagtcagtcgaggacagctagggagcatgaggcaaatcttttcaattgtggggaagcctctgaatgatctgtttttgcctttttcttctacccttctcatcgattccatctatcccttttcattactggttgcctgcaccttgtgcaaacagaagtcttaaacagtgcaggatcttcagtgacttttttgtcttttgatccggggctgatggcttttcattttactcatgctttatatggcatagtcaagtctgattgagacttatttggtggtagggcagtcagaattactggtagaaaagaaatgcaattttattactttcaagttcatagaatgagaagaagtagactaataaagtctgtgccaggaagttttgccaagtagaagtccttggacttgttttaatgaataaataagaatgatgtgcaattaacatacttattgtttgtaaattgcttctaaagtgcctaaaaacaatttattcttgttagtttaaacattttccttgtaaccttgtttataccacaatttgcccagcaaacctttataaaaatagaaacagcagcctagctctatccgaatgctcaccaaatatgaattactgaaatctgaactgcaaaggtatgactccaacacgggaaagcaagtaagcctgagatggatgcttttaggaagtgagcagaacagattttcccttttctacttaggtgttagttgcaaaggcagaaggttatagttagttgctcagtactatttagagaggaaaaatgctcccttcaccagggagcaatacttgtcatcattccagctccccttggtggtctaatgccagagagtttctttccactgaggcagtaaaaatgagaaaatttaccttttagataatttcactacgatcaaacaatccccagtgggcaaaactaatagaagatactgtattttgattgcagtttatctctagcaattataaatgagcaatttaagtggcaacaaagcaagttgtttgctagaatgaggccgtatttcacagagctttatcattcaatattctctggatcactcagctaaaggcagtctatttccttgggtggatcatacatcctctttctacagtatccctaggaacaattacttttcttaatgatagggtattgagaagaagtgatctacaaacataatttacactaattttcacttttttcctcccatgagaaatttagttgacaagactttgagtattaggttttattcttccaggatttcttaagagaactaacaagaaggagctgggcaagtagagagaatgtcagaagagctcagttctgaatccatgcctgagtttccaataaccagctgcgttgctttgggggtggttgtaagtttctctgggcccatttccttatcttcaaaatattgtgtgtgtgcacgcacacgtttgtgtgtgcgcgtgtgcaagagagataatagattagatgaactctaaggtcatattgaattttaatgctttacgagtatatattctgtgattgttcatgagcccaaaggggaatttttcagtttttcaaagctttcagtggacagcatagcattgtcaggttgcagtaatgatttcgagaacctttgcaaatgactacatttggcaataaagctactgtaggctctaccatggcctgaagaaataattaatattgcataaaaatatatattttttaatttatgaaggatagatctcaaaagggactatagattgaaagcagaaacagtaagtgagccaattgggcttccattttctactgtttataaatttagactgggtggaaggtcccctggtttggaaagaaggagtcttaggttcttgctctgactctgccagtaattggctatgatcatggattcagaaacttttgggcctcagtttttccatctgttaaaaggggaaaggagtattttgcctatatacatctgcagactgttgtggttattagaagggagcataggtcaaggctttgtaaaaaaaaacaattgctatattaatgcaaggtgttatttgagaaaataatttttaaaattgggacattgagatacacagttctacaggtgtttctcattgtgctagattgtgaaacattgtctttgaaggtgtggattatatcatgttcaatattatgtatattacacattggcatttcaatggaatgggaatagagggatggggaaacaacattagtttggttttgacttaaagccagttttttctactaagttcttgggaaatgttgaaagaaatacaagtctaggaagcacatcagcctttcttaaaagagctttgcaaactttgcatttctgattcaatctatgaaagagacaggtgagaggttcctatcagctgttaatcagttaaccaacagtgggtgagcatttagccagtgccagggacagtgacaggcactgaagataccaatactaaaggtgtggttcttgcccttaaggagttctccaacctagtgggggtgagatataactaagcaacacaatgtgttaggtgatgtgatagaggtaagtatattccttatatttccttaggtaacatttcagaaccggcgaatcctgggtgacaagcctccggtttctctctaaggtactgctgtccagtagaactttctgtgatgatggaaatgttctatgtctgctctgtccaggacatggtagccacatgtggttactgagcacttggaatgtggctactatgattgaaaaactaaaattttaatttaatttaaattttgtgaatttaaatttaactagctacatgtggctaatgtctatgctattggacagcacccccctgaggaatggtagtgtgagcccacagtcaggctccaaggaggtcctgagttggatcatagaaagctctggtcaatttgcccctgtcctttaaccctgttttcctatccaaatactgcactagcccttgaatggctcctttccagccgacaactctgaattatgcatgctaatgtgtgttactcaaccatggcatgaggttccctcactcccctcccccaaccctgccgtaaagaaagggtactctgtgacagttcaatcatgatgaaggaagaaaatgggtcgaagaaaactagtttataaaagcttttaaaatgtctgaaatcttgcttttcacataatttcagatggtgtgaggtaatttcaactctctttaagctgagttttagctctctttctctctccctctccctctctctcacacacacacacacacacacacacacacacgcacgcacattctacctaaagtgtctgctgtggtagatggggctccttgtattcctattgaatcagcaattagagaagttgggtatataatatatttattttatatatatattatttatatatataaaataaatatattatatataaaataaatatattatatataaaatatgttttatatatatttatcatgtacagaatatatattatatgcccatatatatatatatatatatatataaaacttcccatgccaaaaacacaactcttcatcacattattctttttctgatagcgtagataaagggagactgagataaaatatcctagtaggaaacctcagaaagaaaactattcacaatattcaatgggagtttagttggacatagaaataaatattcagaagaaatcaagtttacgacctggtaagaagacttgccatttgtctggtgattcacagttttggaaagtgcttgcacatttggtcctaaaaaaaaaaatcccctagaaggtatttgggacagatattatttccattttttttttttttttgagatggagtttcgctcttgttgtccaggctggagtgcagtggcgtgatcttggcttactgcaacctctgcctcccgggttcaagcgattctcctgcctcagcctcccgcgtagctgggattacaggcatgcgccactacgcctggctaattttttgtatttttagtagagacagggttttatgttgggcaggctggtctcaaactcctgacgtcaggtgatccgtccaccttggcctcccaaagtgctaggattacaggcgtgagccaccgcactcggctgatattatttccattttatagattaggaaatcaagagtcagagaggctccatgatgtctgcaagggcacacagctagtaagaactttttctattttcatcttgaaggctctgtgattggaggctttgtaggatttttcttttacatttttttcttatgtgcttttttttttgaagcttataaccatctgcaagaaacaatcaccagagtaactttttttttttttttgaatcggagtctcgctctgtctcccaggctggagtgcagtggcgcgatcttggctcactgcaagccctgcctcctgggttcacgccattctcctgcctcagcctcccgagtagctgggaccacagcacccaccaccacgcccggctaatttttttttttgtatttttagtagagacggggtttcaccgtattagccaggatggtctcaatcagctgaccttgtgatctgctcacctcggcctcccaaagtgctgggattacaggcgtgagccactgcaccgggcccagagtaacttttgaccctaaatgaagctgggtctaccaggaaccaacatttaaaaatacctatacacaaaggtacatcattgtttccttcacaaaaattatatataatatacgtatatatagacacacacacacagttaagaaatgactgcccacacctgtttctactggtttagccccgataaaagtgtttctttgctatcaaatagacacaggtattgagccgaccaggatgaggaaagggtgtaccagcttccttcgagagaaaggtgtgtacataagagtgaaagaagaaaggggtctctaaacatatttgaaaaattgaccaagagagagctgtggagggaggaagctgagaacaatgtggggaaaggaaaggacacatcaaccacactggttgaggagtatgctgtctgacacagtacagcgttatgtttctgacagtgttaacttttgttttttgaaagttaagtttaaaattggtcctgatttttgctgctgggagtctgatggtagaggtagagtgaggtgttcccctcattatttcatttcttaatcttcctgcaggaggaaattgctctggttgtgttcactgcctttgaacctgtcgtgtttaagcaggctagtgtattttttttctcccaaatagtatacctcgtcagccagtcctatttactttgatttcactgcattttccagaatcctaatgaggtgtggcctagtggtgtgagcgcaggacctggcaggaagactctcaaattctagttgcagatgctagatgcttctatgtagtagagggcaagtctcttgacctcttctgtaatgccgttaacagggttaataatatttatttagctcataaaggcagcagggggattaaatagttaatgttgtttaaaaggctttgagaaaaagaaaaggcaagtttttttgtattgtgtgcattttcaaatgctaattcttattaacaggaagcatctgctccattacggtcattcagcacctcatgaaagtcttgctggctggatgggaaggaaaattcttcaattttgtgccatgagatctgagaaaatgtagctaccttcagccccagttatgaacttggatgtctgttttctccctatctaaaaacattcttcttctttatgtggtttttctaaggtttagtagtttttctctcttttgcaatcttttatgcttaccattactggtgcaaaatgactattgtgtttcagctgtggggggaatgaaccctttttataataggcagttagacattctggaagtctttgtgataaaagatttcatagaaatacaaggtgcttcagtaattgttctgttggtgccttgcataactgcattacagatttctaatactctggcagtttcaagatgctgatgatattagccactttgtgaagggtaattatggctttctatgcatggttgccagcactctcatgtcagattatagtagccttttggttaatctctattttaaatcagatcaaattctaacccaccctcatccctcctcatcccccttcccaaataaaatgagaagcactgtgaggatttgggagaaggacaggtggggtattttagagaatgagaaaacatttctattattattttttgagtcatcttcttattgcttgtcagttatggtttatgaagtgatgccaaagtataaggtctatcttgcctccaacgctgatttgctgcaatgcttgtttaagttgctagaaactggaggctcctgtgggtttccttctgtgcctaataatttcaacagagccaaatgccctttatttactacagtcataattagagggctgccagtgttaagcaaccatggaatctgagtttgagaaatgtttattgtgcctcattaaatctgaaatgagtacttaaaggtcagaaataaataatctgtttatattttttgtgacagtaaatataagtgaatgctgtgtgtacatatccttgactctactcatttcagtgtactgagacacccctctgtttgccaaggcagtaatcacaatatctgcgacaaaagagaactatggcaggtttcattgatcacaaacaagaaaatgatctattgtattgtatctaattagaaaacatcaatattagaagctaatgcattcactgtttccaagatggtctatcacttgattgttttttgtcagcatgatcacattttacgggcttgagcaacaagctggtacaagggaaatgaatttagaatgatatgccaaaggctgttgctccttcagtcttaaataagcttgtagaggcaactgggtttttagtggcacataatataaataatgggattggggttggaacagaatttgggggtgttgttttggcccaaaggcacaaggccacccaccgctttctctctaaatattttgaaagtcttttcagctgacaaagcttactcaatagaaattgtactctgcacactccgcaggcagtcagggctctgtagctggtaagtggcagagaactgaggcactgatataatagaatttagcagaaaggaatggaccagctcaggttctgagggtgctagtccttctgtgagccagaagggctcaaaggtaggctggatccaggagagctcatactgtgggtttctggatcccattgcttgtgggagattacacagacacacacacacacacatacacacacacacacacactcttatatgtgtgtacatatatgtatatatattatgtatatgtatatatgtgtatatttatttctttattagagatgggctctcgctatgttgcccaggctggtcttgaactcctggccttaagcgatcctcccacctcagtcttccaagtcattggggttacaggcatgagccacaatgcccaaccctcttgtgggagatcttatatgggtttcttattgtcagtttgaccagctttaccaaatcatagcttctaaaattgaaaccaccatcatgactattaatcttacatcttaggtcaccttctaacaatggttgccattgcctctaaagggcaaccaaaatggtcaccaaggtttcagggaacaaagtggctcatttctggatcccttgggctctgtgagtaggccctccagctaggtctggagaatgatttccagttagtgtgtgccaagtttttcctttgtctaactgctggactatagtcccctgactctttcattggaattagccaaggaaatcactcagagaaacataggtaggaagcaggctaatcacttccctgatgttactgttttctgattgcttcctatcccagtagcagaaaatgccaaaaacggtgctcctggggtttctcttattgtccttgttgcggcatgctctagctgagttagtacttaatgtggctgtagcacttaacgtgtgtgtttgttttcatggctctttaaaggggaaataacagttggcacttgcttgtaaagtgctttgatatttggggatgaaaggcactctgtgcctgcaaaatagctttaatgtgttgtagttacatgtttggtagggcgattggactccagaatttgttccactggcaaatgtggttgagagctatttggttctccattaagttctgtttacatgggattaaatagtttgacttacatgactgaatttttcattttatttgctcttgaggtactcttactcatactgagatattgttgattctgcatttgtacatataataggcattaactggttccagagagctttctataagcagatactatttcagagtgcactatgccccacaaaggacttagaaaagggtcgagggccttattcagaagcctgtatttgttttatggcatggtgtttaagctcgtctttcagcaggctttgaattgtatggtttactgcagacagctgctaggtttctcaaggaggcctctgtagtgaaattcacaactgggttgctcttctaaaggcataactttgacccaaagatgagagcaaagaaaagtgctttccctaagccatctttgccacctctaggtagggtgaccacatcaatggtgccagtgaaacaataggaatgacgatgagaggctgctaggaggggaattctttcaatttaatttgttgaatgttaaccacatggcctgtgtttctcattgatagtcctgtcctgacagtcactgggatgctagagttgtttaccacctgtagaaaagtagctgccacactgtccgtctgtgactcagaggtctacattctggtgaaccctcgtcttctcacagaaacgctatcaaattgggttcaggaacactatcatatgttgtcaccaccattcccagagatgtggcaggactgatggagttagatgggcagaaggcacctaactgtgtcatcttatccctttcagttatatataggctattgtgtatttataaggtagtagttgggagtgataacagtgaacaaattgtaactacagaaggcagtgtgcagagtggatgctttctgaagaagtagaaccaccttggcctaataaacttcgtcacctgccttaattgtgataagtagcctcattcttaatcccttccatctcttctctgatcattcattgatgcattatatgaacgcatgctaaatgtttagcgttgtggcagatggcacagggacctcaaaagagagcttccagtcccgttgagggatgaactgacacactacacatgaaataatcatagaacctgaggaaatgcataattacattgtacagtctgtatacaaagtgctgagaaaatgctaaggaacgtgggatgatcagtgatggagatatattagaaatgagggaaattagatggcttgtgttggatgactgcttagctaaggacttcatgtagatttaatgttaattgcaacaaggagctactgtaaggtcttgaaaagagaagtgatgtgatgaaaatagtgggtgaggaagattttccaaacagcattttgcagaatgaggtagaacaaatgcaggtgagaaaaaaatgacacaaggtgatgaaggctgtggaaatggagccaaaaggacagataatatgggctatttctaagaacgttatgaattgtataacctatttgataggatagggagatttcttgccttttatgatgggggttatgtacatatgacacatatgagggccaaattctcccatgtgagtcacctacagccattgagccattagggtgttatttagttctacaaagtagcagtgtaattctccaagttgcagtccagtagcctgcgtacaagtatatgcctgtatctgcaggtacataggtgccagtctgtgtatgtgtatttacctgaatgtctgacattttgatcatctctggtaaaagatccattagtttgtgagctccttgaaggtgcaggctatttttttttaattcccagggtttggttcatgcttactggatagataaatgaataaattaagaatcactttgttttagaagcctagaattgtggagcttgaaggcaacatggagtccttttggttattctcctcattttaaagaaagataaattaaggcctcaagagggttaatgtgattcatccaaggtcatctgtaagttaatgacaatcctagggagagaatccagctgtccccactataccacattgctttctgtagtcaaactgtgtgtgtttgtgtgtgtgcgtgtgagtgtgtgtgtgtgagagagagagagagaatgaattagggctggggtgtgtggggagcatacaactgacaataagtggttagtaggagtttacctagcacgttttctagttcagggcaaatatgaactttgtaatgttggcagctggggatggtgccttttattccaccttcactaattcctgcttcagttgctgctgtctggatggatgagtctttgaatatacattctagctggaggcacgtcagctttatttttatacagaatttgcatattcatttttatgtgttgggggtaggaagtaggcaaaaactatttattatctcatttccaaaagccatctttgtgaggagatgaccatttgaacatctaaaacagcaaccagctttaggaaaggttatgtgtcttttcattatggatcaataggcacaattatcattattggaagtcagcagttaaaaaaagaagcagcgttttataatcactttgttgtgtatctgatacgggattccagttttcctgttttgattgctaaaatgacttaagagttaaaaactttaaaaaattaggtagcaaattatagttataatgcttttcagctcgatgggactttaaaagtgtaacttaaaagttcgttcattttcaaatgaaaatctaaagatttgagtaacctcagttttaatcccaatgtctgcaaccttttttttttttgcttggtatagtgacctgggatttgtgccactggacaaagagtctagtcctggatatctgcatttattgggcttccttctccttaggtttgaagtctctctgctgataaatgtggtgctgagagagctgcagtcactcttctagagactagggcacgattcagtgaactgtaaaagtaatgcaaaatgacaattaaagtagggcattctctggtaccttgggggcctgacaaagtggaagtatttgacttctgatatgccagacttactaacgtagaaatgtaataacatatcccccacccaaacgtcttactagaatcctcctatatccagaagggacctgagaacagcaagtagtaagcaaagaaagctcccaagcagctaacaaacaaacacagaaacaaacaacgaaaatcaaaacattgcacaaaggtccctatattaaagatcatgtgatttcccccttaggagcgcaacatctcagctgtctatgcagaacgttacaactcttttttttctagacacaaatataattgtatagtttccaagaacacagtagagtaaaagcatcaaacttgaaatggaagaaaagctacttttgatataccaacagcactgaaaagttaaaaacgctgtgtttgatagaaggttggtgacgatcctatgttaaaaattaaagacaagaaaaaaaccacagcagtttggggtccttgagtatacaggcaaaatctgcatggggtaataatttacatttataaagatgctcctaagtaaccaataagtggttaaattatgttttttataccctattttaaggagggcaactttgtgatatgtttcagaaacaaggcagatggttaggattttaaatcaaagttttggttcttaaaggataacaccctaagctatctggaaaactgagctgtctagaattatttattgtttgagaatttttaaaaatcaacattttattaaacctaggtcatgtgagacacctgctttcagtgttatacccaaggataaagaattcgaattagaaaaagaatttgtgataaatatactaaataataagaaagtgactcttatttaccactgagatgaaataaaaaagtttgctctagacccatttttttttaatgtgacaattaggtttttccaaagcaaatgttgttcttatctctttgctgtgttcttgtgttaacctggctgtctgattagaaatggggacatttcctagtgaaattaatgtgacatttagagaaaatttcctctctcaaatgtttcatgttgtttgccatttagcatacttagagaaggtattggaataatgtcaagcaaattttgattaaataaggctaactaggagccaatacattcatgcaaaaaaaaaagctcttgtattattttaaagaatgtatttcttctgtggttctttatcccatattgagatgaccttggcaggtaatctgacaaaagaaatgacatcttctaaacagctgggcttgctttagaaaatgcagcacattaggtcagagcctgtggccagtcctttgctcaagacagttacttgccaccccggaggtacactaaaatttcctggaaagctttttaaaaaaatcacccagtgcctgggtccaattccaggctaattacctcagaatctcttggagtgggtccttggtgacagtatttttatttttatgttttacaagaagaagattctgagatgattctcatgtgtagttagggctgagaaccactggcttaagacatacaaactattcattaagaaaatatttccttcttcaggatgatctgatgatctgagtctcatcctttgctccaccagaagtgtgaaaaaatatactctctcagtgcacaggagttgggtttgggcatacaccttgaaccagtatgagctagaacacttgatgtcagtatacatagacccataatataatagcccatctatggccagttaactcagttgtttggaatgtagtactaatgaggccagaatagtgtattctatccaattagaataattctgctgcatagatttttcccataactgtaacccaactgcctcacaaagagacctgagacggattacaaaggcacaggacaatgggtgaatcagcatagccccatccattctgggaaaatcggttctaggaacctgccacattgactagcgctactaattgcattaggatgcagcatgagacatctgcccatgatggtttgtgctgatttgggggaatgatatattttcatttgaaggtcaggacccacaagaatgggtggtttattccttttggagttaaaaaaggaggataaaagataggaaggttacaagcttctatgatattcttctctttacagtagcagatcatgcctggcacatctgcctggggttaactgacctgtatttgggggaagaattgttaaggtaattactaacaagccctcgagacttgtctcttctcaactcagtgcctgggagtgggaatcctcatgatgagatatattatggcttaggaccaagaagtagtattttcattagtgatacaatgtgcatggtattgcttctttgcctgaacacgtggctctggcaccatgcctggaggtcaggtctccgcggagcttcatatttgatgcagagtgcacacaggttccatgccttcatttgcaaagatatggaaaattttctacttgagaactgtcttctttaaaggcagtaaagacagattctttaaatacagtagcttgggttgctgcttatccttttcctgcaaagccagtatcctctagatttcctttttgtatttttgtctctttaccaatcttcttgaaaaaatgatttagtttgaaagatgagatggaacatgcatgtgccactattttattgcctgaatgaggtcaaattcctgatcctacttggagttagttgcaggttctgtataaagcaggggatcaggattcccaccattcctgtcatgggtctgataaatgcagctgaaattctcctttggattcatgttctattatccctattttacagagagggaaactgaggcatgcaaggattaagtaatttgcccaagatcgcagagtgaaatgaatatttgaactgctgagtgcttaatcaattccgggttttaacagatgtattagtccattcttacattgccctaaagaaatacctaagactgggtaatttcataaagaaaagtggtttaattggcccgtggtcctgcagactgcacaggaggcatgatgctgacatctgcttagcttctggggaggcctaaggaaacttacaatcatggtggaaggttaagggggagtaggcacatcacatggccggagcagcaagagagagagagatggggaggaaggactacacacttttaaataaccagatgtgataagaactcattcactatcgagagaacagtaccaagagggatggtgctaaaccattcatgagaaaccgccaccatgatcaaatcacttcccaccaagccctacctccaacattggggattataattcaacatgagatttgggtggggacacaggtccaaaccacatcaacagggtagcataatttttgtggggtagtgaacttcccacttgttaaattatatattgtactgaatatcgtagatgaacacatttaaccaacatcatttttacctgttatgttggtacaacgaattaactcaaagagtgtttgttggttgactgactgttggataaacttcttccagcaaatacttggattgtattcctaacacagcttccaagtttgcctcctattcctgtttgtgacaatttcagcattcactctctatgaagaaaccagaaatgaactgacccttttgatttttaatcccccaacccatgcttccaatagcattaaaaattgcttgagtttacattaaaaaggagatataaacttctagataaaagcagtgtgagtagatattacacagtgcatcttcaaatgaggggcatgggtgggcacatgaacatacctgagtaagtgcagggcaatgttggggtttagtttccttttaagtactgtctcctcctctctctcacacattcaccgtcccccttcctacctattgtaggcacttggggtctgtattctgactgctggctgtttggtgcccatgtggtagctggatctgctattgcctgttctgttttcttctccatcaaactgtgagctccttggaagcaagggctgcatctaggagcctagtacagttagtatctgacaggtagaggtctgagaggaatctgctcttttgtttgctagacagaaattgtgtttccttttccaaacactcccagttgaagtaatttcagaaggctcctaaggaatggtgggaacagtggagatttctagtgggatggcaagagggtgggggagatgtgtttgggtagtttctagatcatacaatggttcaagaagagtggtactttagtgctgggggcgagatccactttactaggacattcagttactttagtgtcgacttttctctggatttcacccttctaaggcttttcccctctagttctcccaacctctgggtgatcattagctgtttttccatctctttcatctggcaggtattctgcatttgcttttataaagccattgctccagcagtctgctgtaaccagattaaacaggggtgctctaatgataggagctgagacaggggtttgcttgcaaacttcatgtttcacatgaaaggctttggcaccccctgtggactgcccttcaccctgttttaggcatagtatttgtttgcttttgtatctgtgataaaacaaaggccttcctgcataaccagtgctgagcaaatgtcttgaaacaaagggaagtgcagagtttaaatccacagtggtgtattaccttgcctgcatttccatatctttggaataaatattttaacatgttaattatctactactaataaaaatacctttgaacttccagtcaatttgatgggccatagaattgtctccactggggaatgggaagtaattagtttctgtaaggattgtaggtcacgttgtctcttctcagtaagtggttgcatggtcagtagccagtcatattctagggaatgtttgtgccaaggccgccctggtctgcagcggggagctgctgcctccacggagcccctagggcctgaaggaggcagaggctgctgctgcactgtggccttgggttccaattcactcactgcttcttgacccagaagaaaaattccttctaagtagggcagttcgaaatctacttatgaatcatctgtgtaacctttttaattttttcttctcattgcagactgaaaactattcttttgactccaactacgtgaatagccgagcccatttaatcaagaggtatgttggtttgcttgcttattgctgcaactaagcttgatttaacattaaaaagcaaaacagattaaaatttttaaaacgtatttttttgggggattttaaaatgaatgtccaacctactatttgtagaaagtttggaaaattgagaaaagcataaaaaagtaaataaacatcactggtaatttcatcaaccaaaggtaatcactgttgacattttacatttcttggtatgaaaatgtacgtataaacactcaacaataaaattggaattatattaaaatatagttttatctagtgacagaaatctgatattacaaatattcactatttctaatatttctaatttctaatattatttctaatatttctaatgtgatattagaaatatacaatagaaaactttcacaatcatgttgataccaaaattcttgttgctcttcactttaaataaaggaaagccttaaaaatgtttttcatgtagaacttcccatgagttttgagattgatgctatttcaacaactttgaaatcattttaaagatattttaatgacagagaagccaatcctttcctttctagatgagagagaaaaagaaatttgcctgattcttcttaaaatttttagaagtgtttcagaggaaacattcaaagttgagatttatgtgattggttgatcataatttagtatccaaggagccataatggatgtgagtacagagctgaatcctgccaagaaagatcccatctggtgcagtgggctgcacccaatgggagaaggacaaggggtttgggaagccctctaaaaggtggaaactgagcaaagaagagaacctcttgcacagaaagaccagtcctaacctttcaaatgatgcctgtattgctgtttcatgtaaatatcacttaaatggtccagtggttattctgcagctaaaattgaactctgagtatgtttgttaaaataatagaaatgaaacagagaggccagcagggtatgttagagctgtagcagagaaggcttgcaaattgtattattttgctggctctaatcccataaatttacatcaccagaagagtagaattcaaggaataaacaagcttcaagtaacttgcattcatgtctgatttaattcatgaggcttcagtaacccctaaaacatgctaagtttatctgtattggtctggaattgcttgtgaccttaagtgatgatcattagttgtctgaaaatgggtagcccttgtattatcagtgaaagcacagttgagaattttttttgaggggttgggaggaatccatttagaatattttcctgggtcacagaataaaagcaagaggtgaggaattcaaaattatctgacgaatttgttttagaaagaaaaaaataaccctcttatgtgcactgattagagtgcctttgtagcagaaatctgctttgtttctgcttccgaattgttattttcaaagctccattttaaaactttgataaaaacagtgacttgccttaccctcacaggtccctcgggctaactcagggtacctgggaattctatagccaggttaaacagataacatgatgctgggcgcagtggctcatgcctgtaatcctggtgctttgggaagctgatggtggagaactgcttgaggccaggagttggagaccagcctgggcaaaatagtgcaacccctcccccccaccccccaccatctctaccaaaaagaaaaataaataaataaaataaaaaaacctgatagtatgagtctgattgtcacagcctggaagaaagctaagactcccagggacccttgcatcttacatcagtcctgactatccaatttacaaggtagactgatagataaaaacttatgtttgaacatttatctttggggatacatgtatttccacagcagcgttgagacttactgggaacctctgattttggttaattactttatatgttttttgtttatagacacatacacacaaaaggcacaacctagacttaatgggctcttggtgaaaaagtctcctgattttgcatgaaatcaaagatagctttttcttcttttttttaaataaaaccagggaccaccttgatgaagaggaaacatctgaaaactcagggacacatgcatttttgccagggttctgtttacagagccatgagagctttgggaaactctgaaggccttgaatttgtgtggtcaattgagtttagatgaagcataatacctagaaaaatacagggaatcttgtgtgctatgctgttctggggaccaactgtgttaaatgtaaaatgtgtggaaaatgttgagagtggtggctaacaccaggtgataaagtcatgcgaagcctgttcaaatagctcacaacagtgtttgaaaagggttttgctgtatgtggtttcttgaagatccatttacatgcatggtaaacgctcttggccaggaaattctgaatctgattatcagttttaattttactatcaagtccctgtttctttgaatgccaatacaatacaatttcaggctaactttgagaacttctttttctttctttctttctttttttttttttttttttttgagacggaatcttgctctgtcacctaggctggagtgcagtggtgtgatcttggctcactgcaacctccacctcccgggttcaagtgattttcctgccttagcctcctgagtagctgggattacaggcatgcgccaccgtgcctggctaattttttttttatttttagtagagatggggtttcgccatgttagccaggctggtcttgaactcctgacctcaaatgatccacccaccttggcctcccaaagtgctgagattacaggtgtgagccaccgtgcctggctgagaacttatttttctatccatgttctcttcttctattcactttctacttatccaaggatgtttcttggacccttcttttcggcattctctagcagttgttagcattcttagccagactgtttacatacaggcatcttttcctcttttacatctatctaccttgagtagttgaacagcagctaccactgtccacctctggttctttccttcatcagtcagggttcctacatgaaatagttggcacgcctaaattggaatggcttgaggaaagtttatttacaaagaggaccatttacaaaggcttgggcacggttagtgaacctcaagggatactgcagtattatggcactggaggagctaaaaatacttcagacaggaccagggaagagagcatgtagggaacattgacttgagagtaacagtgacttctggttggccaagggatccagtcatcatgaagtgaccctggaggaagggagcagagacaatcaatatcctgatatcactgtcctcccctgctctgatctcccgctgatgtcttcctttggctaaacccaacagaaagccagagggcaagggggttctcataggcacaaatcaaggttgagaaggatctcaactgtgggaaaaggaagtgatatggcaggctccccataattttatgcaccaaggaatctagcattatatttctgtagttttttttttttccagactgtcacttgcaacccgcaggtgtacccaaggaggcttatgtgagggccccagattaacaaatcatggcagtgcagagtttcttctgaatggacttccttcctgctctgtttgtttcttgctgtcttctcagagcaaggaaagccagcagtggtactttgtcgctgctgcagcactctttcctcatgcctgttttgtgggctgctgtctgatatccactcctacagtgctttgggaacaatatcaagcagggcataaggctgtggcccaaagaaaatgaaataggaaatgaacaaagcactgactcagcgtggaaaggattaggagctttggctccctaaatcatgcacaatgctttctttttccacccaaattgtcctggggtttttccagcacttcgtatggtgccttgtatataataaatgcttggtacatgtttattgaatgaatgcatgagagaaatggaagaaaatcttagcatttttctattaaagactagcactagatttctctttaagccagtgatttctggattttaatgtgcattggaaacacctggaaggcttgttaaacgcaggtatgctagctccatccctagagaacctccagttgtaacaggttcccaaggtgattgtgatacaggtggtccagaaaccactctaggattttccttgtattacttaaatacagttataataatcttcattctcactccttgctcattcttagcctcagatatcattccctgggtatgtagtatcacctactagtaagatataacctgtttccattctgagtcttatgtcttttggaaaagagttctaatatttcagatggtaaatatgggtcagaatttgtgtgatgttcattcgtcatgcatctgctgagtaactcttctgtgcagaaccctgttctaggtgttttcaaacatatctgtctttttgttggccaccagagcagtaatagaaacatgggcatttacaataccattggaaacaggaacccctaatttattgtcccacaaaagttgttttacaagtccttcatctcccaagaggtatgcaggtaataaagcaagtgaaatcagcatttttatgcctggcataaattgttatttgttttgggtgagtagccatttaccaggctattttacaatatgtggcatcttgctcactgggtcttaaactgccttacacaaatccattcattaaaccactaaatgctcttacaagatcagtgtaagtggtgcttagtttgtcagatgggcaaactaatctttaaatgagttaactattccaaggtttgggggagttgttataccttgctttttgttctgagaatacacaacttctcgtgctcacactaccagtcccttacatcctagtagctaatccttcactgttttattatttccataatttctattcaaaaagcaaaatctctgaggttgtttgtaacattcagatgcctatgaaaaagatgatcaattttttaaaaggcagatccaaaaccaattaggagaagtaaggtagacatccctggcatccagggaggtaactgactgcaattaaacattacatttatgttgaagtttttgagaagtgaagacaaagcagtaagtacaccaagtgatatagttttaattattcattaaaggaaggatggccatttgacaggagaactattattttctgttctttaatgttagaagaaattaacacacacacacataatagtgtgtgactattgtttacagaagatatagaagtgttctttaaatataaattttctgtaccaatcctataaaaactatggacataatatttaattgtaactcagtgaaaacattactacacagaataatgatggtattaaacaataaccatttatggagcatctatgtgtatctggtacttcatgtacagagtctctttgagtcttctaaatggccttgtgaagggggttttagcaaacacattttacagataaagaaactgagattcaaagacatcagatatcaggtccagggtcacacagatgaagtggcagattatagattattacttgtcctaatgactccaagttcagtgctctttactacagtctgctatagaaataaagaacctagagcagttgttctcaactgtggggtgatttggcaatgtctctttggagacacttttggtttttttcctttaagtgggggtcactactggcatccagtagataaagggcagggatgttgctaaacaccttataatgcacaggacggccacaacaaaggattttgtagccccaaatgtcaatattgccaaggttgggaagccctgctccaagggctggttaattacattgcccccatactagatccctcaccatcatatgtttcaagcaagtttcaacagctgctgaattcagagttgaattctctggcttaaagtgacaactttgtgttgtggattaaggacattttcagataccagaaaatatacaggttggaaagttaagtatttgttataaaaatggacctgaatatcatccaggcaggtcatttcctttctccagaggtacaggggtgcttgtaggcaggcactcacctcacgtgacagagaataatttctaaaaaacaaactttacatctatttaaactgtgggattataatagtatttacagaaaactccgtaatatgtgccataaagctagaaatggtgaaacactttaaatcatgtgtttccaattggccatcatggccataaaagaactgtaagataatttgcttgtttgtttgttttttaaagaacggcatcctggtgggtccataaggctgagttagctgtgtgacataaattgaaggagctgagtgagctggcctattgagtaattttaattttagtgcagttgatgctcagttattctttctgaaaataattagctaacaggtcaatgcttcactctctcctgctcttcattttcttataattatggctttccagttactggcctcctggtctttcctttttatattcaggtcagcaagcattctacatctaggttggtcatatgttaaaaatctgctgtgattcttcttgactaagtgtggagggtgacaatgtatccattgtgtccatggcatagctcttcattatatgtgctgaatcttcttatcagtctcagagagccaggcctgtgaatgtccaaggttgagcagatcaagtgagtttgcggtgtcatttccacagggctcttttctcagaggcataggtctattagggtttgtgttaattcacaaacatgccattcttccttgttgaggcaacaacacattttcttgagtgtgcctttgctgcttcctcaccgactagggaatggattcaccatctactaggtatttcagatgcataatttatggttcatggtgtagcaaagctggggattctgtcaggacatacaaagtattagaaatagtaggtgggtgccctatagctgtaccttatgcattattctccatttcatgagaaatggtgtgaagttcttggattgcatgcatagtgcattgtatggtagattgatttaataaatgcaagaatcattttacctatcaacacttgagctgaaagttttcatgttcttagtataactatactcagagttgcattagtgctcactctctggctctcacttttgtcttgccttctatattagtcagggttctgcagagaaacagaaccaataggcatatctaaatctataaatatgtagaaagagttttattgtaaggtatgggcttatgtgattatgggggctgaggaatctcataatctgccatctgcaaggtggagaaccagggaagatggaagtgtagtttgaaggcctgagaaccagagagccaatagtgtagattcaagtctgggtttgaagtcttgagaaccaggagcgctgaaggcgggagatgattaatgtcccagttcaagcagtaaggcagagaacaaactcaacttctttcttaatttttgttttattcagtccttcaatggattggatgatgcccacccacattggagagaattgtctgttttactgagtctgccagttcaaatgctaatttcttctggaaacaccttcatagacacacccagaaataatgtttaaccagctatctgggcattccatggtgcagtcaagttgactcacaaaattaaacatcacaccttccacgctcagctactgactctcctctttttctttgaatatgttcatctatttttctcagataaaactgacttactgggttctctgatcctgataatccttcctattttagttgcactacttcaatttctgctacctttgctttttacagttggttagtagacatcttttaagaatcagtgtacatagtggttaaatttctaggcaggctctggagctagactacctgttttcagtcttaggtctgctatattttttaccagctgtgtgaccttgggcgagttatctcacttccatgtacctctgttttttttcatctgcaaatgagaatattagtagcacctttctcttacagagttgtgatgatttcaacagttaattaatgtcaaacacttaaaacagtgcctcacgaatagtaattgctcagtaaacactagctattattattttactttgattttataggaagagaaaagtcttctgaaatgatgacattctttagaggcagttttagaattgtagcttcttccaccttgtctgtagtgatgcattgaagataagtgaacgaaaatattagctgtatcagcatccaatagtgggaacctctgtgcaatgttaagttttattatctttaagcacaaatttctcttccccttattcctaccctattggacagtctagccactgtttgcctcattacagagccgacatcatcctggctcagaaagatttttaaaatcagatctgtcacggtcgtaaattatcattctgtcttcaacccagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatggtaaggactggttggatgtaagttgcagcaatcgactccaaagaacccaaaatgtttgtaggcacactatactactttgcttaatgagtgtattatcaaggtgtctacagagctcacacctcagcagcatctacaggtttttgagatgtcctgacacctagccagattcttctttgccctccctaagtggatcccctaggtctgtataaagttcaggcactttagaagctgactacatgtgcatattacatacattttcttcaataaaactgcactgagctcataggagatgaacagatgccttctctccaggaataaatgcctatttttgctttagtacatgaattcagctgatcaatcgaattgcatagaacacagcactaatgagaccaaaggggtgggttttatttccctatcagactggttagctttacccagagtgagactctgttctctcattacagattgtgtactatttactgaggatagaaaataccaaacttcccattttgtctatggggctgctatgccaaatccctccctctagcttccacacaaaaccatgccattagtcataggggagaccagggtaagagaacgtggctgagtcaatgtaaaatattccgttaatgtgaaaggcacctcaaagcacatgtcaggagtggcatcctcatgtatgaagaagagtctatttctgtgaactcggaactcagccacacatgctttatcgagaggcactatttaaaactttgctaggcagaagccagggtataaaaacattagcagagttcagctaaggcagaatgtttagatggacttgggcacaaatgtcattttcaatattttactgatgcaaacatgctatgcaaacagcctgtctttttcaattaagaaatatgaattcaacttggtggttaggctcagtgaagcttcagaatgcttggctatgtcttgagaaaagctagactcaagctcagctggaagccctactgctaaaagacttaaaaatgagaaaacaaaatatggtgattatgtgctggtcttcagctgtttcatttcactgtaaacatcattaaatgcttttgttttggtttttggaaataagtccaaaggaaaaaatgtactatccacaaaacaaaatgtttttcatggaaaaaaattagtcactgtagattctattaaattgtcttaatccattccctccccagcagacccaagtgtcaaagtctattatatagagaggtcactatgaattgtgcactgctgtcttccctaattggtgagtggtgacatctgcagagataatacactttctgggaaaccttactatgactaaagatgaaaaaaattaaacagttatataactgaaacagagacaatttaatactcagaggattagcagtatgtcacaggatgcaaactgatatatatcatttactagttgtgtgtttcaaagaaatgctttttcatttatatcaagaaagggttttagttagatgctctctaaaatgaaatgactccaggaaaggaaatagtcataattgattctcactttatgcctggctagaacaacatctgttttatttttttgtcacatttctctaggaaaacagtatcagggaactgcagctagttttttctgagagagtgtttcttacaaattggatgtattacatatatatgtgtgtgtgtatatatctatatatgtgtactgtgtagattggataataagacgagtattcttttttgtgaatgcatacctaaattttatttcagcttagtcatttgggttgaaggtagagaccaccagtctccatataggtagagtgaccacataacccagtttgccttgtatacctcactttacatctgtgtccttggcataatcaataatgagaatattctaaaggaaatgtgtggcaatactccaagattcccctacatataagatgatgattttacacacacacacatgcatacacacacatacacactttctgctgggccattttggcaacactttcacattttgtttcttactatttgatttgcatgtgtgtatcttcattttttctattattccggcagtggttaaaccttgagccaacccttgagtgagttcttttcaacttgtgtgattgcctaaagtttaggtacaaaaagaatttgggccttgtttatacctcagtctctcccttgtgatatcccactacttctgaagctttctgtaataatacttgtgtgtcccatagcaacttcaggcttgccacagattccatcaccagttcacttggactgatactgcaacctcaaaaaagagcaacaattccaacaattaacatttcatagcattttaatatctcaagtctgcatttgcataataagtatatcacattttatcttaaggtacagtggttgaaaggcagtcactgggtgatccaccatgcatgcctgatcttatagccattttagttagattgtcccagggtaacatggtattgttgcttcaaaggattaccaatttagaaaggtgagaagggaaaatagaatctgcactggactgagacctgtactgaaaatctcaagaattccttgaggagaaaaaaactagtccccaatccccttggttcattgacagtgtgatgggaatcttaaacccaagtgttctgaaattcttggagttccagagcaactgttcttgaggtttgggtaggtgtcactggagcagaatgaagaatgtagtgaatttgtcaggctaactctgatcctggtatttcttttagtcctgccagaaccactccaaagttgggccaaatgtatccaacaagagcgtaccttacacctttgttttggggagtttggctcaccttgtattccatgtctgtagttctctctgtgacttttctaatttggatattagtactgcatatttccttgcacgtatgtggacacatgattgaaggggaatctcagaatttcaaaataaagataattttgtgcatctgttagtttttcctttgagcaggaatggtttgttcaaggagctggtattgtgttgcctgtgtttggggtaaaggtataaactatatttgctcctctttttaagagatacctgggccctgtgcttttccacactgccaaaatttctatgggatttgtccttaagattttattgtagcagaagaatgatcggtgtgaatgacaagggtgctttgtgactctgagtaagggcccaaattccttaattttcagtaacccttctctgagaacattcctagaggtgggaacccagaatcactatatttaatgaaggaaggagaatgttatattcaataaaggaaggagaatatctagaagacttctttttttttttttttttttgagacagagtctcactctgtcacccaggctggagtgcactggtgcgatctctactcactgcaacttctgcctcctgggttcaagcgattctcctgccttagcttcccaagtagctgggactacagatgcgcactaccactcctggctaatttttgtatttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgccccgctaattttttgtatttttagtagagacggggtttcaccatgttgggcaggctggtctcgaactcctgacctaaagtgatccacctgccttggcctcccaaagtgctgggattacaggcgtgagccaccgcgcctggcctagaagacttttgaactcaaagggcaaaagtcaggtatttagtcactaggaagtttggattatgtgtttccttttcaatttttaaaaatgtctaaatttattttttattttgtttataattgacacatcataattttacatgtttgtggggtacaatgtgatgcttcaatacatgtatatgttatataataattaaatcggggtggttagtatatccagcaacctcaaacatttatcatttctttgcagtaatagcttttaagatcctcttttttagctatcttgaaatatacaatgcattgttataagctatagtcaccctactatgtatagacaccagaaggattgtgtttgattgtccaaccagacacattcgtgagctcagtgagggtggaaatgagagagaatgacaggaatctctgctttctggattactgtcaatcttggtatttctcttgacatgcctaagaccaggtcagttggttgatgaactggctaagctgaatttcctggttgccagctgactgaattacaaattgatttgttatccagtgcccatgaattaatacgtttcagtttgtccttagtattcagctcttgttatggcttcccagaaaagaagatgatagagaattctttatcctgtgctttctactggtgtattgtagaatggcaatttggaatgctgtctcttaatagctctgagtggcttgagaccaagtaagtgttgtcattggcgggttttaccacttgatttggttcttgaggcaatttggtgctgagcttgggagtcaacactcaaattttttaactgatgccttctgtccctgagggaattacttggcttgagggagtctgagttacctggtaaaattaccaccctttggtggggataagaattttgcctttatgcggttcctgcagagactctctaaaaagagtgattgacaagtagagtagtgagaggtgccagaggctcatgggtttgttgcgtgattaggggtatcatggggcttgaatttcttcctatccgggttatctctgagctaagtagtgggggctggggtctggctccttcttgcttctttgcataacaatttttgatgatgtggatatcccattattcttacttaaatatgtaatcctgatatgagattggggtttatagggatcatgccctagaagtgtacactagtcccaagctcagctattttgtttcaaattacactcagtccctctttccttatggttttaattattgattataaattcatcagatgaaaagatgactctaattgctctaatatgcacccaatttggagttcgctacaacactgaattggtttccctccatgctaactgataccaaatggaagcaacttacagaatttttttgtaagatttagctgcttttcatatccaaatgcgtccaaatgcaatataatgattgctttatttctggaagtatagattcttctgttttagtagacttgtttatttaccagtttcatcacctgaatagcatttaacatgtttgctgtgtataacatggatttgaagaacttgatctgtacctaatgcaactgctgttaacaaatttgccatgaaaatgttctgtaggctgcgtactatgcttattctagtgtcaaccacaggtatattaagatgtttacactttcaacactctaccaacaatatgtaattttgtttcctctagccatttaaagaaattatgattccatgactgaacatccttcttttatcttcttatctgtcccccgactcacctctctcctcactgaattttgaaacactcatttcaattagtctcttggcaaaatagggagttctcaatggagactattttgtgtcattgcaaagcagtgtgctgctgggctccagatatggtagcatgggccagatgttcatagagtaattgaaaattccattttatcagaatagcatttgctgtcaaaaagttttatctttacgtgaacaaagcggttgattagatccccctggacctgaattagcatctttgaggctagatacactgttttgcaattcatgtggttatttctttcccagttttgctcatatagagactttaaaaaatgtcttcatcctcttgcaaatatacctagtgaaatttaattacttgaacccaggaatgtgtatacagcgtttctatatatgtgatttccagctgctttcatcctgcctctggtatactaggcaggaataaaccatgaacagatatatatcactcattactcagtaatatttttgagtgcccactatgtgcctggctctgggaattgaatgtgtcaactactgctgttattgactgtaaaagttgttatctttttacttttattaatctggggtttactgaggtgaccaaggccagctcaatgatgaaatgaataattctattttaaaaaattataagaatagattttggggccattaaaaaccttgtgaatattgtgccagtaaagcaagagaagcaatatgaaaagactgttacaatcaagatcttattttcaatgggaatgtcatgaaatattcctcctttgatgttctaatttggacagtatcacattggtaaacatttttttttaaaatccacctgttgtgaggttgaatttcctactcatctttggttaatgtcattgtaggatgctaagtttaatctctgacatgtccaattaccttgctggtttagaggcagtcagtagcactcaatgcctagtacccctttttttctgatgcccagaaactttatcctttctctcagtctcagcagtttttgggcaggtaggaagagaggtgacaggtggagctttttcttttttttagttcaaaaccaattatctgctgtaccacataattggattttttccaaggcaacatttacattttattggaaaaataatcactaaaataaaaagttgttcttcactaatggaaacctccctgttgttagaatttctttgctagtattcttttggcatgggccctttggtcaaataattgttttaggacagttcaccattggtttcttcatgcaggacattaagaataatatcaaccgtttgtctaattttaaatagatacgctattgtgttatagcatatctatttaacatattgtgttatagcatattgtgtttcccaacatatatatatatatatacagacatatatatgtatatgtgtatatatatgtgtatatctatatgtatatatatcgggaaaacacatgcacacacacactatacacacacacacacacacacacgttggttatatatatgttatgcggttcctgcagagagtctctaaaaagagtgattgacaagtagagtggtcagaggtgccagaggctcatggatttgttgcatgattaggggtatcatggggcttgaatttcttcctgtctgggttatctctgagctgagtagtgggggccagggtctggctcctccttgcttctttgcataaccatttttgatgatgtggatatcccattattcttacttaaatatgtaatcctgatatgagattggggtttatgggaatcatgccctggaaatgtacactagtcccacattcctggattcaagtaattaaacttatatttgcaagagtatgaagacatttgtaaaagtctctatatgagcaaaactggggaagacataaccatatgaattgcaaaacagtatatctaacctcaaacatttatcatttctttgtggtaatagcttttaagatcctcttttttagctatcttgaaatatacaatacattgtttctttccatatgtatatttatgcttgctttcttactctctgtatatgtagtgtgtgtgtgtgcatgtgtgttttcccaatctacttggaacttttagttgtctgatattcaaggttattttaatatttattattactaataattacttgtggtgggctgggcatggtggctcatgcctgtaatcccagcactttgggatgctggagcaggtggatcatttgaggccaggagttcaagaccagccttgccaacatggtgaaaccctgtctctgctaaaaatacaaaaattagctgggcatggtggcacatgcctgtaagtccagctactcgggaggctgaagcacaagaatcacttgaacccatgaggcagaggttgcagtgagctgagattgtactactgcactccagcctgggtgacacagtgagactctgtcttaaaaaaaaaaaaaaaaaatgaagaggaaaaaaacaaacaaaaaacgaaaacaaaaacaacagaaaaaaaactacctgtggtaaggaattcattactcatcaaaaaataaatgccaaagcttttcttgattagttgacattaagaatttccatatttttaagcattttgaaagcattagaggatgcaggatatgtaaaaggagcacaatgaacaattaagaatttcattctccagtagtttatggcccaacagcaaaaatggtccagtatggaatagactacataggatcggtgaagaaagtaattaagatttttgagctggagaccaaaatgcatttaaaaggacactttggtgtaatgtgatctctttggaggaatggtggaagccaggccccaacatagtatgctagataaaattatgctctatttgggtgatttactaggtgaatgttttccagtagcttcatgaaaaatcaacttctataggccatgaaaagtagggacactgccaataagttaatagatgagagacaaatcaagttgttttgtgggactttccctttctttctttctttctttctttctttctttctttctttctttctttctttctttctttctttctctctctctcccttccttccttccttccttccttccttccttccttccttccttccttccttccttccttccctccctccttccttccttctttccttttttctctttctctctctcttttccccttcccttctcctccctcctttcttttcttttcttttttctttctttcttttctttttttgagatgggtctcactctgtcacccaggctggactgcagtggtgcgatcacagctcactgcagccttgacctcctgggctcaggcgaccctcccaccttaaccttctgagtagctgggaccataggtgcatgcttggctaatttattttggtagagacgggattttgctatgtttcccaggctggtctttagcccctaggctcaagcagcagtcctcctgctttggcctcccaaagtgctaagattacaggcatgagccaccgctcccagcctaacattatttctgtcctgtcataagatgattaagagccataaactcttatcaggatgggaaatgataaatctaaacatggattttaaatatttgtagagtatttttttctgtttattttcctcttaatccttttgttatgaaataaatatggggaattaagtccattcatagccagtttaagggattgataccaagcattttttttttttttttgagacggggttttgctccaggctggagtacaatggcacgatcttggctcactgcaacctccgcctcccgggttcaagctattctcctgcctcagtctcctgagtagctgggattacaggcctgtgccaccaagcccagctaatttttgtacttttagtagagacggggtttcaccacgttggccaggctggtctcgaactcctgacctcaggtgatccacccgccttggcctcccaaagttctgggattacaggtatgaaccaccgcccctggccccatagttttaaaagcaatttcaacaataccaaaattatgtatcatttatttattctgtggacaaaatagtcgtgagatggctttcctcttttatgatagatgctttttgtcatccagggtcaggacttgcccaaggtatttttggtctcttgtttttatcagatggctcagtgccctgtatactttgcatcaaggaaagcttaattgatacatccactttggaaacgtggctttttgacaagaaagcctttttaatttctctttctttatataaggcttatccccagtaaaactccagcctagaaaaatcattgtgttactccattctcacactgctataaagaaatgcccgagactgggtaatttataaaggaaagaggtttaattgactcacagttctgcatggctggggaggcctcaggaaacttacagtcgtggcagaaggggaagcaggtactttcttcacaaagtgacaggagagagagagaatgagggaatgagaaagtgctatactttaaaaccatcagctcctgtgagaactcactcaccatcatcagaacagcataggggaaaccgtccccatgatccaatcacctccctcccttaacaggtggggattacaggtccctccctcaacacatggggattacagtttgagatgagatttgggtggggtcacagagctaaaccatatcaatcatcaagcaccaaattagaaaaggtttgagctgctctttttaggaacatcagaaaagttgctttttaggggatcacacacaggttcttcttctgggcatattttcaaagatctgacataatctaggcttaggtcttagatggacttgtaaagctcacagtggatagataaaacagactcttttgcaactggacaaagtggaaccccatagaccaatcattctgccaggtagagagaatataaagcagttcctcatagtttgcgatgaagagattattaatgaaatatcagtctccagagctgttttggagcaaatcctttgggactgtaagtgtgtgtgtgcaggtgtcaatgtcagaagggtgctgtaggattttaggttttgtggtaaacactggacttcacttaacaatgtgccattcagagatctaatatgtggttggaagtatgtgtaggatggtgtgtaaaataggtaattcgaaaggcagtgaatctggaaggggccaaaagaattgatcagaaaatgaactctttgtgactgaagttactcaaagttttgtcacattgaggcggcctaatgacaaatacttttttcttttgagggtctctggtcatcagaaacaatagttgtacttcattatccttcatgacagtttagacaacaaaaatgcaagctattaaatttgaaataatagacaaccctgttttatcattagtttagttctttttaaccttagtaatactcattttaatggcaaataaggctctttaggttactgccttagtttaacaggaaaattttcaatctggctaaagaactctagagttttagaactctaaaagcaagtttatctccctctgcccccagtaagctaagccttagggcctttctaaattatggtctagtccctagactctaagtaatgcaggactgcaactgtaatctgctttgaataaaaatacaacttataatgttgctttctttttaagtagaaatctgtaaacatacagtactctaataatttggagaaacttgatactcttgcagcaaggcagcttccaagtcatgggtttgcaaatccaagtccaatgccagagatatattttccaatttctgtggtcgcttttccacctctaagctcatatattctctccttttctatccttaacttgcataataataaatgtttgacaacttgctttctttcctcctctttcagtctctatggagtttccaacctgtgtgaacaatagaatatttcccttttaatacatggaaaagaggaaaaagaggaatgatgtatgtttcgagatatttaggctggtcaaactgttccaaggcatcaccacctgctgtttttaatcattaatgaggctgtcagttgctctaatctgggaggtgaaccaaaagaattgttttgactttaatttaatttaaaaatcagcttattgaaaaaaaatgcttccagcttctatgagtcaggttgcacactgttgataaaacaaagcaagtcaaatgttgatgctgaaccatcattcatatgcaaacgtgaaccgttttaaatttgcagaactcttattattaccatcactagccagaaattttagttctttttttgtttgtttgttttaaacagcgtctccctgtgtcgcccaggctggagtgcagtggcgcgatctcagctcactgcaacctccgcctcctgggttcaagagattctcttccctcagcctcccaagtagctgggactacaggcgcctgccaccacgcccggctaatttttttttgtatttttagtagagacggggtttcgctatgttggccaggctggtcttgacctcctgacctcgtgatctgcccacctcggcctcccaaagtgctggaattacaggcgtgagccaccgcgcccggccaaattttagttcttttaattcaagtagtcattgtattctggagacatgctgcgtgtaaatatctgttccattttttagaagaaaaactgatgcaccaaaattttaaacactctattaatgtcagaacacaaatctatagcaaagtccagagtgaagcctaaagtgcaaattcttttgcttgactcaatgctcatcacactgtttgtatgttttagaagtttagtgactatctgtgagtactctattaagttggagttttcttcactggatggttttgcttagtgacaaaatgagaactcagaaatacagtgtctgtgcacaagtggattttaacgacctagagccagacctttgtttgtgccaactgtcaatttggaaggtttcattatgcctctctcagcttcatcaaacactttcagatttataattgatgtcaactgaagttgaagtcaaagaaaaccttctttttttgactgtagaaaatatcaccttattgttgggccctggttagccggagggtaggtgtatcaaatcacactagccttctgctaaaacagcaagtgagcacttgctgaattcagctgataatcaatctgcagctaatgagtctgcagacagactgagcggctggagctggcaccaggaaaccaccattccaactaaccatctcttattaaccttttggtgtttcctttgtgacgctaattagagacccataaaactatctgctctagatcttccgtttaaaatacaattttcaaagaaacacaattcactttaaggctcctgttagtatggccttttcaaacctcatgaaggaaaatgactgacttgccatttaagtaaagtttggataattaatctgtaatgttttggtaattaaaatgccaggaaaagttggttctgtagttggtataatttataatactctccagattccggtggtactgaagtaggcggcagatgtttctaccaccgttatgttttgactgtctgaaagtacccattcccacgctgtagccctgtctgccagactgcctgtctgcctcctcctttggtgtgaatttgttttgattgcctgagggggttagatgtgtgctttgcttcctttctgggggatgatgagccaaggaatgagctttgtactcttgggagagggaaaagtcttcgaagttgacatgctgtttagctcaaaatgagttatcaaatgggcccactcaacgttcaaactgttacatttgcatgatgaagatggaggagcaccatgccttcctgctctagtcccccatctcatttcctctttaatattttttacacccagaacaagagcattatgagataagtgttctaagcgtgttggacccatgtattcatcctgtgctttcgtttacctgtctacagcaccttttagtgcctcatttctctcatttgtttaaaataaaaaattacctagcataaatgacttacatgatcctaggggacagaatctctagatgaggaattgactgactattaaataagtgagatctgcaaagctggacattgttttatttgatttagcaaagaggtactcttcgagaagcccaatattaatcatctaggatcctttagagattaaaatatccataccagaaatgcaggcacagaacccaatattcttgcagcattacctggagcccctttggtatcttaagttttcattgtcatcaatatggaatgttcaaagtcctaaaaagtccctgaaatcattgtgatatggaactcatgttataatatatcatttatcccttacagcaacactgaaagggagagacaagcatagaattccaaatagtcaacagaggaatgacagccatctatagtgaggatcaaaatcagaatcttggctgatggggaaaggttcagaaaattagaatgaggtgataagagagaatgaaataagataaaaatatctatggttgaaaccgagattggcagggacaaaaggggtataatccagatttccttttatatgtactatctagctaatactcattgataaacctaagaattctaattctcattggagtcttccagacagatagtgtccaatcacttcaggctccaactaatatgagccagtcctaatgaatcagtacaactatttccactctactccattatattcaagattgacatcattagtctgcctgtaaatacaaaggcaggcagaacatcatagtggctaagagtacagactttgaaataatacagatttaagtttcatgcttatctttgccacttaatagctattgaccttatttgttcgaatcctcaattttcacaactgcaaaatgggagtaatgatagaaattacctatcagaatgttgtgagaagatccagataaatacttcctggaatatagcaagtgtccaaaacatagcaagtgttattgtggggactgagtcagtggaatagccactttataggatttcaggtaccctaccactcaaagcccctcatctgtttgcttctatctctgatccctttaacagaaaatgaggcatttcattttacagttactgttcacactttaagcagtccatggggagagaaaatgcatttatttaaattcacactaagttgtaaatagttgctattagattgtttctaagcttattatttgagaggagtggtggggggaagaggatcgtttctagaatattgaactttaaaagtctcagaggggagaatcagaggggagaaatgcatagaaatggggtgacaacctcatgagtttgccagagctattggtgtccaaagaaagtaatttgatttactcactgtgaaatgtctggatgctggaaagctgcctttactatcaaatcatttttctgaatcagcccagactttgagaaattataacatgtctgccaaaggtttgaaaagaggttgtgttcatttacattgcaaaatatacatattcttgagcacttactgtgaggtaagagaagccctggttcctctctggaggcattgactccactttgccctccctgtatcaaaagctgcataccccagccccaggatccctgctgctcttccctgctctccctctcttgcttcacggttcttaaatggctaatgggtggtagacgtcattttgattcctttattttctctcccactgcatgcccagactttcattaaaaaataaatgaggggatgcatttttcatttttagtttattttctaaaaaagccacactgcaaagaatcccttctattctttttttctaacaatggactgaaaaatgctcagctcctacctgaaaggtcatatctccttgccatatgaatgagcttccagcaggtccatagggagagtgtcatctgagaaatgatgggaatttatgtgcctttggattttggcctcattttgtagtggaaaaataaatttgttaatgatagaaaaaaaatctcaaccaaagccctttataaaattctctctctataactcccaggagggagcctctcagacacacagttgataaatgaaaaaatattttttacccttgccttgcttagagctgtttctcttatattaatgtaagccaggtggcccaccttcgctgataatatggtgttgaatatagcaacctgcagttctattgcataaagtattttggcttgtaagggaccttgtgacatgtttgtgtttgtcaacatcctattggaaagtagggcttggggagacatgtacacacatagaactgtgtggaattagggatatgaaaaaaacaacttataacacagaggcaagcactgtgtttttgaaaaaggcagattcattgtgaaaataaactttcttttatagtttgaacattccatgaacaatgtaactggaagtgcatactttttgccttccccaaaatctaaatccacgtgctatatacaaaatgctaagatcattatagtcctggccgggcgcggtggctcacgcctgtaatcccagcactttgggaggccaaggcaggtggatcacaaggtcaggagttcaagaccagcctggccaacatggtgaaaccccatctctactaaaaatacaaaaattagctgggattggtggcgcatgcctgtaatcccagctacttgggaggctgaggcaggagaattgcttgaacccaggaggtggaggttgcagtgagccgagacctcgccactgcactccagcctggcaacagagtgagactccgtctcaaaaaaaaaaaaaaaaaaagatcattatagtccctaacatactttaatgccatgacctactgggaaatgagaattgtagttttcattctattgtttgttcattgtagagccttggataagtcactaacctctcaaagtctcaattcgtatatttacaggtgggatgatgagcaatgttgcattaatgttgataagaccaataatcaaagtgtctatctgtctatctatctatctatctatctatctatctatctatctatctagtattttttcttagtacaatataattgtgaatcggatggctaggtgttttgccggtttttggtttttgtttttgtttttttgttcccttctcttccttggcctgttgacctgacctgagaattgggaactttatgtgctcatcatattccacagattcatagcctataaacaagttacttgtccagtctggtctttggatttctcatctgcagaatggaggatactggtagtacctgccttgtggggtggttgtaaggattaaatgagatgacacatgtaaaacacttagtgcagtgtctgttccacagtaggcacttaaaaagagtagcggcaagatgatgctgatgaaacattctccctgggttcctgtctcccctcttcacttatctacgtctctttctctctttaaaattacaagcaaaatttaagtcccagaaagcagcctcttttgactaatggtttgtcctgatctctcctttacttggcgttctttaatatccatgtacagagtttatatcatgttaatttgcttttttcctgttttttaaaaatgtaaaatgagagagttgataattgttaagacatttcaacttctgagcttcttttattctgattttgggttctgggtacaaccttttcagattcctgagcacacagccatttgccaatggatctgtaatgagtgccacactcaaattaacagatggtgtggtgcgcttgctttgaggggtaattactctttcatcttaatttcctccctttggcattccttctttggatactgttcaatggcaatgccacgaagcataggatgaaaatcaaacaagtagcaggtcacttgtctatctcagacaaaattattgttaaaactaagaaccagtgaaggtctaccaagtgaggggcttgtaacttctagtattagggaccaagtaactcttaagggtacttaattgtctgatcgttcctcctttcctaaacaaggtggctatttctagttgataactgtctccatttttcttaaagtttaagtagattcctcctctatggccatcatgtcacacctctcacagttggtttgttcttaaactcttaacactgtaagccaaatctgatgtcctttcatcgttggagccagttgtaaactgctaactttactatataaactcctttcccctatcttcttcctcctctctcgtcacacacactttttcccctgatgcttcttatttagttctttctccaaccctccctgctttcacctcagcctaattctatccttttcccctctaggcaatttctcattcatcactgtgtttttacagagaatagaaataatttttaatgacattgagaattttttttttgggttttagtggttcagtcttcccttgtgaagatttttatggcttatttttatttggtaaagttaccttctttactattttttctctccttccacacaattcacagtatactaccatgagtgaggaaaaccctcagtgaataagcgctgatcaatttatttctctgaacattaccaaacaacagatgccatccaccaatgtttgatccccagggcagttcttatctaccttattttacagattccagaggtgaaatgatctattgtaaagcagtgcaaggatcagaagagagtttgtgtttcctggatatattatgtgacttcagggcattgttctgctttccatttgaaatctcaaaggctattggactgacaggaagttttcattcctgttatgaaagggttactgcctccagtttggaagagatgttgcttagggaaacagcagcagattatagcagtaaagccagaaagatcagggagtcagaagtattactatgagatggaaggaaatagctggtgtgcctaactagctcaggggcatgtttgatagtacccaggtatgtctacagaactggcacctgtatagatattgacctctcagtgtgtgttttactttttactctttgagttggactgctgtgttttctgtgtcactggtaattccattgaccaaaacacttcagttgaatcacagcttgagtcttcaagtttccttccctctaaccttgctggtttcttgctcatgttgatatttaagaacgttttctttcaattcagcaaagtttccggatacaagattaatttacacaaatcagtagttcttctataccacaacagcgaccaagttgagaatcaaatcaagaactcaaccccttttacaatagctgcaaaaatatatatatatatatatatatatatatatatacttaggaatatacctaaccaaggaggcaaaacacctctacgaggaaaactacaaaacactgctgaaagatatcatagacgcaaacaaatggaaatacatcccatgctcatgaatgagtagaatcaatattgtgaaaatgaccataatgccaaaagcaatctacaaattcaatgcaatccccatcaaaatactaccatcattctttgcaggattagaaaaaacaatactaaaattcatatgaaaccaaaaaagagcctgcgtagccaaagcaagactaagcaaaaacaaaacaaaacaaaacaaaaaacaaaaaaacaaatctggaggaatcacactacctgatttcaagctatactataaggccatagtcaccaaaacatcatggtactggtataaaaataggcacatagaccaatggaacagaatagagaacccagaaataaacccaaatacttaacagccaacttatcttcaacaaagcaaacaaaaacataaagttggggaaggacacccttttcaaaaaatggtgctgggataattggctagccacatgtaggagaattaaactggatcctcatctctcaccttatacaaaaatcaactcaaaatagatcaaggtcttaaatctaagacctgaaactataaaaattctagaagataacattggaaaaaccttctagacattggcttaggcaaggatttcattaccaagaacccaaaagcaaatgcaataaaaacaaagataggccaggcgcggtggctcacacctgtaatcccagcaatttgggaggccgaggcaggtggatcatgaggtcaggagatcgagaccatcctggctgacacggtgaaaccccgtctctactaaaaatacaaaaaattagccgggtgtggtggcgggcgcctgtagtcccagctactcaggaggctgaggcaggagaatggcgtgaacccgggaggcggagcttgcagtgagccgagatcgcgccactgtactccagcctgagcgacagagcgagactctgtctcagaaaaaaaaaaaaaaaaaaaaaaaagaataggtgggacttaattaaactaaagagcttttgcactgcaaaagaaacagtcagcagagtagacaggcaactcatagagtgggagaaaatcttcacaatgtatgcagactaatatccagaatctacaacgaactcaaacaaatcaatgagaaacaaacaaacaatcccatcaaaaaatgggctaaagacatgaacagataattctcaaaagaagatatacaaatggccaacaaacatatgaaaaaatgctcaacatcactaatgatcagggaaatgcaaatgaaaaccacaatgcggtaccaccttactcctgcaagaatggccataatcaaaaagtcaaaaaacagtagatgttagcatggatgcggtgaacaggtataacttccacactgctggtggaaatgtaaactagtacaaccactatggaaaacagtgtggaaattccttaaagatctaaaggtagaactaccatttgatccagcagtcccactactgggtagctatctagaggaaaagaagtcgtcatacgaaaaagatacttgcacacacatgtttatagcagcacagttcacaattgcaaaatcgtggaaccaacccaaatgcccatcaaagaagctgtggtatatttatatgatggaatactaccagtgataaaaaggaataaattaacggcatttgcagcaacctggatgagattagagactattattctaagtgaagtaactcaggaatggaaaaccaaacatcacatgttctcactgatatgtagaagctaagctatgaggacgcaaaggtgtaagaatgatacagtggactttggggacttggggggatgggtggaaggggggcgattgataaaagactacaaatagggtgcagtatatactgcttgggtgatgggtgcaccaaaatctcacaaatcaccactaaagaacttactcatgtaaccaataccacctgtaccccaatcacttatgggaaaaaaaaaggttaaaaaaaaaaaaaagaactttttctttcaaaaaaatgctgatgaaatgcaagtttttagcttctttttttcttgtcatttccactgatctgggctgttttagataggatgttttcaaaagttttatcatatggctctattctttttggcttattggactgcaagtgtgctaaggcccagtcattcaagattgattagttctttgtggtactatatgggcattttggtgattgtcatttctcaaaaatgatccaaaaacgattttccacattgtttaaacacactgttattactcttaacatcccaatagttattgaggtgtttattattgcctttttcttttaattggggtttttattgcataggaaaggggaaaagccctgattcaagcatttggattcaggtcctggaactgccactaactctgtgtgatctcaagcaacttgcttcctcgctttgggttccagtttttttcatctgtaaatgaagagtttggattggaatgacttataggtgcttattattgctaatactctattactgtttattgtatatttaatatggaaagattgtttggaaagtggatgacattttggctggattttcctgtgtatttctaaagaccagggcaaggtgggaaatctgactcttactcctggggctttgggctgtaataatccttccgttgtggcaagaggaatgagggtgagacattggtgaagttggcttttgttcaacattctgagcttattccttcttttaggcttttgtttgcatatgtttagcttaactctgctttcaagtgtgtgtattttcgtggaaatggtcctcttttccttttacaccaaattcatgttctcatcttccttctcccttactgaatcatccatttctgaatagttagcaattttcaacttaatgaggtctttcccctaagtgaagaacacagctgttcctcctctgatactttggcagctgcctctgcctttcccaaaatggaatgattagctctttcctttgattttttagctggccattagttcaggactactagcccatttcctgtgtgatggaactaccaaatcccatggccagaattgttccaatttgcctttagtgtcttttagtcttctggggacttaattcatatgaagtggaggatttatcaatctttcagaggtccatttgcctcattatctccagtgatttcattgttcagccttttgagatgctgatctacgaggagaacctagcctggtgtccctgatgtggttttgctggagaaatagcagataagaagatcctcaatgtattttgttcctgaatcaaatagccctcatttgtcacaggatctccacttcagtttctgaaaagcccttttgcctattccattttagtcttatgtacctgtatttaagaaagtgattactgtttttcctcatgtactttgacttcatctgcccctccagcctttaattttatgatttcacatcccttgttaattgttgggatttccttttatcatatgtgtcccttacacttaagatatcaagtcaacttctccactccactccaattcccctctcacattatgctccctgttaatcaatcaaaagcattgtgggtttagtagtgctgttccaaatgtgtgtggtgcagcccgtttttgcttccccaccccaaacgcctcattcaatttaattccatatacttagcatattaggcatcttgtcaatatttcctttctgaggtctatttttaaaatttgaatgcattctgcatgtgtaggtttttttttttcttaaatgatgagatctactgcaacagagagccagaattagctctgtgcctaggagaaaaggaaagcacagagggaaagaatatttctcacattctcagaaggtgtatgcaagagccagcccttggcacaattatttatacagtgccactatatctatctgcgtgcaccttcccctccatttgggagcataggcatccagtattctccttgggttttcttagtttctgtcaccattaacccttctactcagggccctgcattcccagtctttcctcgtttcctactttccccataaaaaacttacctggtccatgttccatttccccaaaatcctaattatttcaagggacctgttaaaatgacctgttctttctttccaaatagtatttgtatctcaatgtgatgataatccaaaagaatacctaatggtggcatttgggtcaccaatgcagcctgatggcgtgatgtcttcaggatatggccttttccccagcatcagttcctttatatcccaccaatagttggctacatggtcaaatgataaggctagcttggactccatttatcccagagaattagagctgcttgatgaataataatacctacctaacatatattaaattcttccttagtgcgaggcactgtgtagctcagcttccatgcatttcctcttttagtcattccaacaattccttatgaaggtcagtgctattagtcctgacttatggaagggaaaaaaggcacacagagtaactttaagtaacttctataggatagggctgttaagtcttagatctgggactctaaggtagtctcgctccagagcccatagtcttagactctgctgcactgcctctgggaaaaggatggtacctttttcacatgtacacctcactcagaagagctaacttcagatgtgctgctgggtagtaagcttccctttggcaaggaacaaatgaagtcttgagttgctccagtagatctagcttatatctcatcctttctggagagaagtttgcctttggacacaatgctacagcagaaaggtttgcctttgcttttctgcaccccaaaacttagcagtattaaaaactttcttcaccagtccctgtagttgtaagtcatcagtagggatatttgccaaatgcttaggaccaagcttacactctatcttttctctaccttcagagctgaaggagctatgtatgtgtgtgtgggaaggaggctctctttggtgttggtgagcatgaatatgacagactcggggtagggggatacatgaaggggagagcagactcatccacactctcaaggcaagtatggttagaaaccctgcttcactcaggtagcgctagtctcttcactgtaagtaggttttttttttttttttaaatatggtgatacaatgaattgttttctgaggtggatggttgtgttttctgttattactgcttttccttctggaccgaacttttattggctgctgcttacttactagtagaatgcttcacacctgtgggctgctgcagtcatgacaatgaacattctgttcagaaggggagcattcattctctttcccagcagctgttaccccaacattgggaatttaatgcattcatttgttctttagataaataggattaaattcagaatgaagcaaggagtagtcttagtctgtgctttgcatgattttcagggtctgtacagttccagctgtgtaaacatgattgcagaacttaagtatcgtctaatgggggaggatttcaatttaggagtggcacaccatagctgggctggagccagacattcttccacccacttcagtccacaccctgcggagtcggcttgctcagctcctagagtcagaagtgaagatggggcagctgtagttaattatactgtattatagcttcttatcagtaggggatgagaactaggcaagggctaggaaaatctaaaattatatcctcaaatatgctccagttatggcagtaggaaacaaagaaatggaagacattggacaaagtagggcagccccaaatattaaatatgacaagaaaaaatccaataaaatatctattgaaattgtagctacatttatattccaattgattcttttttgtggtcactgaaagcaagagtagagaaatattgtattgattgtaaaatattgatttgttctaatatttggactcagttttgttttcttgagatttgtttaaataatgaatagctaagtaatgctaaagacttctaataaaggagcactattattatggaaggaaatgcaatttcttcataacaaatacaaatattatggatcatccaattcctttgtccttgttcctccacccacaattatgtacagtgttggccctgctcagttcaatagagtcttagatccagtaattattctgtctctctaaagaggaacatgggcatacgtattcctgagccctaaaggatgggatttctgatgatatagcaggttttgtttgatgccatagattctccaggttattcttgggggagtatcattgatagctaacacaaaggtacttggcttcctactggatatgaatgtcaagacatggtcctgatcaaggaagacaacaaagcattgccttttgaatgtgctggggattgtaatgcatttaggaataacccaatcaatgatattcgttcctattacaactggctattgaaaaactatttttctgagaagctcacttcaaaatgtctctgagacagaatattcttttataggatggggagctctggattgaaaaagagaaatgctaggctgataaatcactgagtttgaatcatatggaaagtgttcaagaacagaaagagaggaaaattcaataaattactgttgatgcaatattggatggtcagggtgataagacactcactagagatttccagtctatgatgtacacacatgcattattttgtttactagttgtggtagcctgaagaggcagaaacatgcctccagaataccagcagggcataggggaacctctccatcatccatcatattcaactgtagtcggggggtgatcctgtcaatattgcctatgtggtatctctggaacttgggactgggatgcctattagtgcttcactgaattctgtatttgtagcatgtgcattgtagcatgtacataccatagcacttagctcgtggatgcttgtctgaatcattaggtatgaacattatgggtgccataatagcacaggaattactgcaactaaaaaggaaacacatggcttgtacttcatccacaatcacttacacttaagctattgatagttgattgggatatgtgaactgctgggcttgtgccatgggacttctaagcatatttggtgggcggaacagacaggaaggctgtagattttggcaagctgtggttcccattagtcaggctaactgtatctgacagtagagatcccaattcaccaagatgaagcttacttctctaggttttggctgatggcccaacaatattgacgtgaaggacaggagaggaccaatgttacgttaggctgtgagtttctaatgagcaaatagttgaatggtttagtgaataccctgttggttttttggtggggtaaacacaaaattcataatttgagagacatgtaagactcgaaattttcttttatagtacatgttaaccattcattctcctaatagggaaatgtgggctcttttatagggtgtgcatattatgtagttgtacagttaatactcttctctgtgtttttcttgtaaggggtgctgataacataccctactaaggaaattccaggcacagctgtttctaataataggtgccccaccccacagaattgtcaggcttactctcaaggttctttggtgggaaggaggattttctggcagagtcttggccactgccattgtctcagattgcctccctgtagcttccttggaggtatgagtttctaagcagaaagatttgctgtgatgagggaaggccacaaaactgaaggaagagagatgaggtcttatagaactaagtgagaggctgttttggtcatggcagagatgagttgaacactatggaatggagacaagatgagaagaggagtgggaatcaattcatgaaagcacttattatttataagttggaataaaaggttcattgaactccaggggacccttcttatatgaaatgcttgtgaatatgttgaaattttgtaacggcaattccatcttaaatacactgggggagctgacaacctgcagttcatggattattctatctagtgtacaatcactcttctattctaccctggacattcttccaggtgtggtcaagagaaagcggatagaacagatggaatatttcctctcaggagagttcaagagcttccttaaacaaaggcaagatgtgagcataaccttttactttctaaacaactttttctgagagctacctggaaaaatttctagcttcctcacagatccaagtaatttctgaaaatatttagagactagtaatcgtttaacttctaaaaatcaaagttggtttgtgctaaaaatatcatccggacagtctgtgtctagttgagtggggaagaaaaaaaggcaagctcttggtatcaatctttattccctctgtaaacacacatgaccagaagagaaggctgttattaatggtaatgcagaccagaaaaaagggtattattttcagtctgttgaacagtacaaaaatgcttctcaagcactgtgttcagatgtttctttttattagccatcacacaaggaattagactcatttcaaacagttcgtttccctactcttgtctccgtaaaatcgttactcatgagtggtttctttgttgaaatactgctgacctcccatattggaatgcacaacagggtgttaaaaatataaactttttagtttgcataaactctggaagaagggggacaaagattccccaggagaataaaaccattcgccaatgtccttgtttattagtgtcctataagcatcttattcaggaagctatgtcagcattacaattctgtatagactttgtgtgtgtgtgtgtgtgtgtgtgtgtgtgtgtgtgtgtgtgtgtgtgtgattaacagcagagggctctttgaattccagcaggaggttttaaaatataattctgcatctgcccctctttcttgtcctttccaacccttttctacctcccttctcatcaccgacccatccagggccattaggatagataaaggagttgtgccatgtcttaatatatgagcaaatgatgatccttagctctacagctaggcgctgtttgcattttgccaaaggtgattattttatctgcagttttaatagcaaaccagattatttgctgttcactaactaataaaagcaaataaaaacagattgcaaagtggaattaaggggataagaaagtactagagccaaagaaggctttttctttaattaataatttccatttactcttagaatatttttatgctagagttcaacatcttatattaaacatgtgtgcacccttcctcttataactgccgaattggaatctcagaatggaaatcatgcaggcttgaacggagcttcaaattctcccagtgttgtcttattgtctgtacacagaactagactcctcagggcttcccccaccacagcatggcattcctccattagccccatgtttcccagacccagtcatgaagaactggcattttaaccaacaagtagaaaacacaataaaattggagttcaggagatgcaatgttttggagaaacagattattccaagagtgtaaagatacatgatctaaagatggacagaacatttaaatttaccagcctggttttcagtgattttttgatttgttcaattaatttgtgaatgaaaatgcatcttaaggatggtgaggactggtggtagtggtggtgaatgtgcgtgtgtgtgtgtgtgattttgtggccatgatccaggcttactatgcatcagctcctaaagagatttttacagagctgtgtctgagtgtcttaattcaggtcatctcaaccagagagccttctgctactcctacgtgcaaaggctcgagttaactcagaaaaagttctcacagctgtggcccagatagattccaagacttctctgaaacttcagatggaagagcctttctctttaatagagagccattctctctattaaagaagagttgggcaagctggaggccagaggattatattgtaatcttcatgtgctgaaaggtgtaaagaatcttttcttcttaataagagcactgggacaagcatagggtgccttcaaattatcagacttcctcaaacaatagatcaattagcctttcttctgaatttgtgtaattgtttttgaggcaacaccctgaaaaaatatagcttactttttccgactagtataattaagcggacaaatggaaaaagaatcattcaaagtaaattttaaagaaaagagcaaaagagtaaaatttagcattgtccatgtaagatggataatgacaagtaaacacagaaggtggtgtttgatcccttcgattttggtattcattattcatagttattattcataaattccaggttaggcttgtgccccagtgacacatttgcattttactttaagttgatttctacctggttttgcaaacaaggatttaatgatttgggctgcctctcactcttcctctgttgcttgtcttttcatatacagtgctggcttctagccccttttacaccctttgtctccatcatcagtcttgctctcccatccaatgttttactctcactctctttctctcttctctcttctctctctctctctctcaatgttttaggaaaaaagatttctaacgtggaaaactgatatttgaatagagtcccctaaggctatcaatttacttttaatttgtctggagctaagcttttctttgttgcaatgaggaaggattaaaactgctgtaaaatttattagcttccagaaagatatttgaaatgcatttttttaatgattgtgctgtttgctgtacccagaagcagtgtcatcacaactatagtattccagatggttcccgaagttacactgaaacatcaagataatgctagacttttttatgacgcctctattggtaatgaatagtccatcccaggtagctaatatatattaattaatatatatttgtttccaatgaccatttctagtgatacccagctgatgacaaaacacacacactatccctttgaatcattacaggagacagtgattggtttactgagctctttattttccaaatgtggaagaaatgattggagatttactaatgctgtttcttagcttccccacccagtcctaggaacatattggtagtcaagaacctttaaggaatttagaagttacagttgcaacatttttcatggactcatgtatagtatggcctattctacaaaactgaatgtcctgggacttgactgaaggaagtgtcagttcctgttaaggggaacaccagctgctgggtgccctttttgttccattcaacagtaagttttcattagaaaagggaagatttttctcttggccaacgtgctctgtctactcttgctttctgtgtcagtcttatgtgtgccatcttcactatgtattctcctagaagctcatgaccatcatgaaagtggcttcttcacaagctgatgatctgctagcagtttccttattttccacaaaagagtgaaaccaagttggagataagtttaggttcagaactattttttaagtgtgataggctctgtgactgggcgcggtagctctctcctgtaaaccctgctactcctgaggctgaagtgggaggatcctttgagtccaggattttgagaccagcctgagcaacatagtgagattctgcctctaatttttttttttttttaattagccaggcacctgcctgcagtcccagctacttggaagaccgagccaggagaattcttggagtccaggagttggaagctgcaatgagctatgattgcactattgcactccagcttgggcaagagtgagatcttgtctctaaagaagtttttttttaatttttttattatttatttatcatttttttgtaaaggctctgtcatcctagatgtataactgcatgtagaatgcatctgacttttaaatctacaccaagtcaaataactgatttgaactcttcagagaagtgacaagatgttgtaggtatcccactaatataggtttgagggacttaattctgtgggcgtctttatatgaaactttcaaaaacggtcctatgtttttcagagttgtagtatctcagtgttctatcttttggggaatagctcattggccttctgtgtcacctcatatttactagtaaagttgctttttcaaatggtttataagcacctagatgaagtccagcactttgtcagattattttctccatcacagaagccaaaatacaaagatttcagtctagtcaatctctgcttatctcagtcactgtcagcacctcttatttcttagtctcaattttccaggcagccttttgcttgatttccttgctccccatgcatcagcacaaatgatttatacttatgtacatcttgaaatctcttctttatggattgaattgaatcgagccccagtacaaaaatgaaaactccaggaactgttgtgattgcccaaattacaacttggattgtatgactgtacacgccacactctcatctatcataaatattaaattctcaagcacttatacttcaatatgttttaactttgtctgtttgaccagctcagcactaaagattccattgaagataattcaattgctttgaattctgaaaggggcatctttttaatctattttcatgttgcactgggagttaagtgaatttcaggtgcatagcctgtgaatgatgggagaggcctatgtgccatttggcatcacagaggccaaatattgggtgacatttgctaactaatgctgatcagtgaaatggtctaggacaagattggggttcatcagtcttttcagccattctccctatctcaaactaaaactaaactttgcagaatttctgctgttttgtcagccatactgaaaatgccaagttatgctaaccagggctggccttttttcttctgtcttgtcttttggcaacatccctttgccagtctcaggaactttgttcccacaccccatccccatccttcatccttcctgaggcatctccacatccagacatttctagtgtttttaaccccatcaaatctctcttatcctggatacccttattcagggctctgttatgtgacccaaaaaaatctgataatctcagttcgataatggtgcctcttctaaacatttttttaaatttattttttattttaatagtttttgtggaacaaatggtgtttggttccatgaataagttctttagtggtgatttctgagattttggtgcacccatcacccaagatgtgtacactctacccaatgtgcagtcttttatctctcacactcctcccaccctttcccctgagtctccaaagtccattgtattattcttatgcctttgcatcctcatagcttagctcccacttattagcgagaacacataatgtttggttttccattcctgagttgcttcacttaaaataatagtctccaattctatccaggttgctgcatatgccattattttgttcctttttatggctgagtactatttccatggtgtgtgtgtgtgtgtgtgtgtgtgtgcatgcatcacattttctgtatcctctcattgattgatgggcatttgggctggttccatatttttgcaattgcaaattgtgctgctataaacatgagtatacaagtgccttttccatataaggacttcttttagatacctagtagtgggattgctggatcaaatagatacacttttagttatttaaggaatgtccacactgttttccatagtggttgtactagtttacatactcaccaacagtgtaaaagtattcccttttcaccacatccatgccaacatttattatttttttattatggccattcttgcaggagtaaggtggtatgacattgtggttttgatttgcatttccctgataattagtgatgttgagcattttttcatatgcttgttggccatttgtacatcttcttttgagaattgtctattcatgtccttagcccactttttgatgggattgttggttttcttcttgctgatttgtctgagttccttgtagattctggatattagtcctttgtcaaatgtatagattgtgaagattttctccctctctgtgggttgtctgtttattctgctgattatttcttttgctgtgcagaagctttaattaagtcccatctatttatgtttgtttttgctgtgtttgcttttgggttcttggtcatgaagtctttgcctaagccaatgtctgtaagagtttttccgatgttacctttagaatttttatggtttcaggtcttagaattaagtccttgatgcaccttgagttgatttttgtataagatgagagatgaagatccagtttcattcttctaagtgtgacttgtcaatgatcccagcaccatttgttgaatagagtgtctttcccccactttgtttttgtttgctttgttgaagatcagttggctgtatttacctttattcctgggttctctattctgttccattggcctacgtacttatttttataccagtatcatgctgttttggtgactatgcccttatagtatagttctagtcgggtaatctgaagtttccagatttgttcttttgtttagtcttgtttttgctatgtgggctcttttttggttccatatgaattttaggattgttttttctagttctgtgaagaataatggtggtgttttgatgggaattgcattgaacttgtagattgcttttggctgtatggtcgttttcacaatattgattctacccctccatgagcatgggatatggttccattggtttgtgtcatctataatttttttcagcagtgttttatagttttctttgtaggggttctttcacctctttgcttaagtatattccttattattattattttgcatctgttgtaaaagaggttgagttcttgttgattctcagtgtggttgctgttggtgtatagctgtgctactgatttgtgtacatttgattttgtatcctgaaactttgctgaattcatttaccagatctaggagctttttggatgactcgttagggttttctagatatacgatcatatcatcagcaaacagtgacagtttgacttcctctttaccaatttagatgccctttatttctttctcttgttggattgctttggctaggaattccagtaatttgttgaatagaagtggtgaaagtgggcatccttgttttgtttcagttctcagggggaatgctttcaacttttcgccattcagtataatgttggctgtgggtttgacatagacagctcttgttaccttgaggtatgtcccttctgtgctgattttgctgagggttttaatcataaagggatactggattttgtcaaatgctttgtctgaatccattgagatgatcatgtgatttttgttttaaattttgtgtgatgtgtcacatttattgacttgcatatgttaaaccatccctgcatgcctggtatgaaacccacttgatcatggtggatgatctttttgatatgctgttggattcggtcggctagtattttgttgaggatttctgtatctgtgttcatcagggatattggtctgtagctttctttttttgttatgtccttccctggttttggtattaggatgacactggcttcatagaatgatttagggaggattccctctttctctgttctgtggaatagtgttaataggattggtaccaattcttctttgaatatctgatgaaattcagctatgaatctgtctgactcttgttgacaattgttttattaccatttcaatctcactgctcattattggtctgttacgagtttctatatcttcctggtttaatctaggggagttgtatatttccaggaatttatccatttcctctaggttttctagtttatgcacataaaggtgttcatagtagccttgaataatcttctgtttctctgtggtatcagtagtaatatatcccgttttgtttctgattgagcttatttggatcttctctcttcttttcttggttaatcttggttaatcatttttattcatttttttcaaagaaccaggtttttgtttcatttatcttttgtattatttcttttgtttcaatttcatttagttctgctctgatcttggttatttcttttcttgtgctgggtttgcatttggattgttcttgtttctccagtttaatgaggtgtgaccttagattgtctatttttgccttttcagactttttaatgtaggcatttaatgctatgaactttcctcttagcaccgcttttgctgtatcccagaggtttggataggttgtgtcactattatcattcagttcaaagaatttttcagtttccatcttggtttcattgttgacccaatgataattcagaagcaggttatttaacttccatgtatttgcatggttttgaaggctccttttagagttgatttccagtttttccactgtggtctgagagtacttgatatcatttcgattttcttaaatttactgagacttgttttgtggcctatcatatggtctgtcttggagaatgttccatgtgctggtgaatagaatgtatgttctgcagttgttgggtataatgttctgtaaatacctgttaagtccatttgctgtaggttatagtttaagtccattgtttctttgttggctttctgtcttgatgacctgtctagtgctgtcagtggactattaaagtcccccactattattgtgttgccatctatcttatttcttaggtctagtagtaattattttataaatttgggagctccagcattaagtgcatatatatttaggattgtgatattttcctattggactagtccttttatcgttatgtaatgtccttttttgtctttttaaactgctgttgctttaaaatttgtctgatgtaagaatagctattcctgctcgcttttggtgtccatttgcatggaatatctttttctaacccctttaccttaagtttatgtgagttcctatgtgttagttgagtctcctgaagacagcagaaacgtggttggtgaactcttattcattctgccattctgtatcttttaagtggagcatttaggccatttacattcaacattagtattgagatgtgaggtgctattctattcactgtgcaaattattgcctgaatacctttttttcattgtgttactgttgtatagttcctgtgagatttatgctttaaggaggttctattttcatgtatttcaaggacttgtttcaagatttagagctctttttagcagttcatatagtgctgtcttggtagtggcgaattctgtcagcatttgtctggaaaagactgtatctttccttcatttattaagcttagtttcactggatacaaaattcttggctgataattgtttcatttaaggaggctaaaaataggaccccaatcccttctagcttgtagggtttctgctgagaaatctgctattattctgataggttttcctttgtaggttacttgatgcttttgactgacagctcttaagattcttttcttcgtcttgatttcagataacctgatgactatgtgcctaggtgatgatctttttgcaatgaatttcccaggtgttctttgagctccttgtatttggatgtctagatctctagcaaggctggggaagttttcctcgattattccctcagatgtgttttccaaccttttagatttctcttcttccttgggaacacccattattctttggtttggatgcttaacatagtcccaaacttcttggaggttttgttcattttttaaaattctttttctttttctttgacagattgggttaattcaaaaatccttgtctttgagctctgaagttctttcttcttttgttcaattctattgctgagactttccagtgcattttgcatttctctaagtgtgtccttgatttccagaagttgtgattgttttttgtttatgctatctatttccctgaagacttttcctttcatatcttgtgtcatggttttgatttctttaagttggacttcacctttttctggagccgctttgattagcttagtaattgaccttctgaattttttttctggcaattcagaaatttctccttggtttggatccattgctagtgagctagtgtaatcttttgggggtgttaaagaaccttgttttgttatattaccagaatactttttctgcttccttctcatttgtgtagactgtgtcagagagaagatctaggactcaagggctgctgttcatattcttttgtcccatggggtgctcccttgatgtggtgttcttccccttcccctggggatggggattcctgagagccgaactgcagtgattgttatttctcttctgggtgtagccacccagtggagctactgggctatgggctggtactggggagtgtctgcaaagagtcctgtgacatgatctgtcttcaggtctttcagccgtggatatcggcacctgctccagtggagttagcaggagagtgaagtggactctgtgagggtccttggctgtatttttgtttagtgcactggctttgtgttggttggcctccagccaggaggtggtgctttcaagagtgtatcagctgcagtactatagggtggatgctggatcatcttattttaacaggcattttttaatgcatgtatccagatgaatgaaaaatgtggaaatttttctccatgctgcaagggctggttcttggatagcacttctttggcatctgtcaggtaacaccacataggtgttttgaatgccaatcagtgctggcatcctttcccttctgcctgatgtctgtctgtcattccatagtgttgtaggggagggctgctaacaaggacgaggctagggaacgggagaacaaaaagaaagttttagggagcaaccaaaagtggagaaaattgctgaaaaaaagggaagaagggagtgagaaagagacaagtagttgtttgtagtgtaatttgtgatgtgcttcttgtcacatagagtgactacaggatagcttggtatcattggttcatgagtgtctacagatatctcagccttcactggtgttcccttgaatgttttacggatggaattccatcttttttttgctaaaattttactttagaatacgactgtaaaccccctgcaacattacagcctgggagggctctaggaagttgtcattacgctcatattgaatttttgctagatacataacagatattttccatatgatatctaaacacccaaataagcccaatcctcaagatatcaaacatatcaaaaccaaaataaaatgcctaaagccttggtaatattttccttccttccttccttccttttttccttccttcctttcttccttccttccttcttccatttccttcctttcttttccattgatcccgttgctgctttacttgccttgttaagttacagagatgggattgataatagtgcaggagagagcactattaactattgttagtatagaaaacttgcaggtctatggcaaatgtattttcaacgggatgttagagggtactagatctctctaacacctgtatatagtgtgcaggaaaccacacagaggctaagaggacacttaatgtttctcaagttctaaatttactttacgcctctgacaaagctacatagtttactttgtaggtttctgtagtatttatgataaaatagttatttccactttaggagttgcacagtatctggggtgggacagtatctggggcgttgaccaatattcttccttctttctgtgcatttttcattcaattaaattaaactattattaacagtttaattgacagctctgtgctggacgctttgctaggttgagatagatgtaatctttgctcatccagagcttaaaaggtagcagaaaatatagacatgaaacaagtacagttgtctcttggcatccatggaggattggttccaggactcctgagaatacgaaaatctgtacatgctcaagtcctgcagtttgccctggggaatctggtggaacctgtggataaatgaaaaggtgaccctacaaatctgagggttttgcatcccacagatgttgtattttctattcacattttgtggcagatgcagaacctgcagatacagagggctgaccatatttatttttaaaaacctacatgtaagtggacccatgcagtttcaaacccatgttgttcaagggtcaatggtaattacgcgtgtgatgaatgttataaaagggaagtgctgtgagatctaccttagtctaaaggatcacagaaggactccctggggaagtgaaatttaaatggagacttcagggataatgtattaatcatgaattgtgtttaaccgctagtaataaagatgcccctctcctactaaagaaaataaatcaatgacttaaataagagatatttatttttcttcttattaaagaagttcaagtttggtgagggtagctctacagtatctttaataacccaaggtccttatatctttctattctgccacccacaggcacatggcttctatcttcagggttgcctcatggtagtcagacagatgttgcagcatcagtcattatgtctccattccagacaggacaaagcaggaaggaataaagacaaaatagtctcttacctaagtcagctctccccttttaaggaattttcttaacatcttgctttataatgttggtccaatcttatgttacatgtctgcaagggagcctgtgaaatgtagtttcttttagctgagcacactgccattcctaacagaaatggggctttgtttctatttaacaaaaacagataaagatatttggcaggcaattagttatctctgcttcatagagtaggagttagataggtcaagggtgggtggtgtacttctcaacaattaggtttcctcgattaggcacatgtgaccaattttaacagcactaaacttcttcataatcattgtcataatctcctccattatatctcacaaaaaatggccctgctttggttacagattgtcttgttcatgaggtgatgcagaataaactaagtagatgtataagagtacaattcaggaagcttgtctgatatacacatcacttgcttgttggttctactactgctgccacttagaagtagccaactacttgagctctcaggaactggaactcactttaacttttttctttctgattcattgattgcagattatttctgaagaggaaacatattgctcttgtaactgtaaccttgaactattttagtgctggattttcgtctgtgatcattaggatctttgagttaatacacccaaactctgaatcacagtaaagaactgccagcattatcaaacacatccattgtgactggatatctatacaaacccagcagagcctcttagctcttctattccaccaggacttggaaagttttagcaaagcctgaaatgatgttttcatcattttcttttattactttggtggggaccatgggtaggctctttctagtgtggaagtacattgtttggccacatctgaggagatggcagtttcatgtcctgaggagagtagtaattgctgcataaagttttgctattatctgcacaaaatagcatattctggtctttttctgtttgaattacttccttaatctatcatgacttagtcattactgccttactgcctcttttgcctcttgtaccctcgcaagactgatgctttaattttttttttttttttggccaggggttttggaattctctcaccaagtttcctgatgacaaattgtgaccaccaaatacttactgctatgtagattgaagaaactttcacttttttctgtattttttatggtctaaaataatcagatttgttttgaactaaggagttctctggtctcaagatttgtgttcctcttccaaatttatgcactctgttcttgtttcttttgcaaatcctagggacaacttcagaagcagggaaaaccaatttacaaattcatcagtcaaccctcatcatgagtatgtttaaattaaagacacctgccttcattcatctatacgtgaatttccacaactatatgtggattttagaatgccacattttgctttgcctaggttcaggtcagaactttcagataaaaatgtagcaaagtatcaggtcacagataggttcataagaagaatctcagcaggaacttagtgaatcgtgagcccatctctctatataagctggagccagcaccttgacagtttgtgatgctacaaaatggttcttctctagtctcatagctccattcccagccactatactacatgaggactggcacataatctttacaagtcctatacaattacagaagtagtctttttaatttttatttttttacatctggtctgtcttcattgctatttttaaggggctttgtattgtgactttctcacatttactacacaatttctttactaaactgaaattttgatttttgaaaggtaattcatctgcagtatatttatgaatgtaaattaccctgtgctgggcagagatgttcttcctgcctgtctatattgacaatttttatttcatatataaagtggctataaacatatttaagctaagttagacttcattgtaactgtatagacaaaaatgtcacaaaatatctgaaacacaaaaataagaaacagtaactcagtgcccttggtaaggacttaaaaaaaatataggtatcagatccaagccaaggatgagacactgtgagtaaaagagtctcttagattcaagtcttcacttgcgtgaggaagggcagtgcatataataagtttacataagtaatctgagaaaactgcatatgattccagctcatatggagctgaggtaggctcagtgagcttggtggggaggcttagactgattgcattgttgggtgtgtcctgagttagtctccgtttctcttttcccaacagtgattgtttcatttagacagtgggtcagctgaaggcaagtactatctatacagagaaacctcagagaagattgaattccctgctctggtcttccaagatttataagatcttggaggtgtctgtctctgggctctctattctccctccccagatattctggggatccaagtctcctcatgctgttcatttgaggcagcctagtatagggaaggagcattgtacttggattcagggtgacacatgggtggtattctcctattgaatgctgttgaaaaaaactaaatctcaaaattagaggacagtcacttcatattaaaaaactcaaagaaataagagcttcgtgttgaagacattgggcagatggtactcaattgtacttcactactgctctgctctagaagtgtgagcaagtggcctgaaatatcagtcttaatcttggctgggattttcttttcttagttggtcatatgtccatggtttcagggctcaagggttaggtctttatgcttttatgcctttcaggtagggacaaaaagggcagagatcttatagccttctggacatttttttgctggcttccagggatttttactctgatttgtagaaatggaaataatttattgaacttttcccccacctgcaactgcttactctctctaccctgaaacactctcactaattttttagaggtattatttggaaagttaccagataggccttggaagagatgaagaggcaaaaacagcttattgggaagccctaaagatgtgacttctgttctactgaagggatcttgggacctcctgtggaaagcactatatttggaggaaactgattaaaagtagatcaactaactcttccactcatactgtttagtctacacaaagtgcttctcaagtatatcccaaaatgcttcccttactttcatattttctgcctcccaggtacatgcatgttgaatgataacagggtatcagatggcaacacagagagtttgcagggaaggggcggagaaagggccttgacagacctttcattttgcagaagtggccatgcagcctgatgtggaactgagctggagtttgcagaaacattgtcctaactaggtggaaggcactttccctgttcatgatgttgttcatttgttatttggttccactgtacaaaattctgagtgtttcattgcccagcactgaaagggggatgaaagtgtccatcttaaagataaattggcaaattatgtcaaggtacactgaagaggtcttgtctttagtttgcttttaagtagcttaaatgaggtcaagggccatgcccagaattgtgttgaaatctggatttagcttggattaggtccttgatatttaacaggcttctaatgtctttcctccaaataatgaagtgtacagccaattcaaccattattccttgagccctctgccttgtgccccttcaccaaagaacctttgatgaatgaggcatagcagtaccttgctttgctatgccatttactctttaaaaacaatgaagaagcaaacaaaaaacaccaaaaatatagaaatacaagtatacaaggaagatgtgttatatatagactgatgccaagtaagactctgaattgcagacatcttccccctgcaaaataagtcacaacataaatatatatattttatatacatatgtatatataagatatatatatgtattttctgtaaatgttaagctgctcatattttgatgcattgcgcaatgttttcattaggtcatcctcttgtaagaatgtaacataaatataaatagatctggaaaactagggctataaaacaaacattgagattaacagttttccagtaacaggcagaagttaaccctgggtccatgccttggtaaagcctgtgcagtaagcctctctgagagccagattgaagctttaacccttagtgaacctgacctggaaagataaatctatgtctgcccaataattatgaattgtaactgctgagatcttccaggatggagttaaaataatccatgaaagatttctttaagaaatatttctctaacaaaactgcagataagaaagataaggagggatggctagttgggtctaattaacaatgaccaacatgtcactgatgtttgcgtagggccaattgaagcttatgggtcagctggatagaagggctctcagtttattccttctgatgggaaatcaagtcatggaagtggcatagtgaggagattggctggtgggactggtggtcaaaaagaaggggtgtgattgggctttcacagagagtaggatatcaatctaaaattaaattaagcactgtgtatcagtgatgggtagggtggaagggtgtttggcagtgctgttgttcaaaaatatggccaaggcttcttaaatacactgactgttggattcccttccctgcctccactccctcatctgctgaatccagtttcaaacacaggtgatttttagcaggagttgttgattaaaatgctgactctcagcaccttgacactccagatgaactttagaatatatatgtattttcatcataacgtgtttccctttaggttttttgttttgtcagtagtgggaaccttaaaaaggatatacatagagggagatcttcagccttttaaaaaaatccagttcttcacacttgtcccaaaaggcaataaaggactacctaaaagtgccatttcccacaagggcctgtggatatctaagaaaccagaacactggggagtaacagtgaatcctgggaaaagctgatgaaattgatattttcttttttccaaacagatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagt

SEQ ID NO: 4774 - DNA, 8136 bp, human
agttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagattgtactccacagagagatgcagacaaagtaaacaatgaagtaaggtgccttttaaaattttctatttggcaatatttgaagacttaactgaatgcaaaattgacccagtttttaattttttttttgagatagagtcttgctctgtcgcccaggctggagtgcagtggcgcgttctcggctcactgcaagctccgccttccaggttcacgccattctcctgcctcagcctctcgagtagctggaactacaggtgcccaccaccacgcctggctaattttttgtattttttagtagagacggggtttcactgtgttagccaggatggtctcaatctcctgaccttgtgatccacctgacttggcctcccaaagtgctgggattacaggcgtgagccactgcacctggccagtttttaatttttaaatataagctgaaatagatagggcgggtaagaattgagttcagacggccagcaagtaacacttttttgtttatttattatttagtatttttttttaaagacagtgtctctctctgtcacccagtctgaagtacagtgttgtgatcatagctcactggagccttgaactcctgggttcaagtgaagtaacacttttaaatatataatccagaaggtggaaataattgggaataattatttgttctgttgagaacatatggaagagaatagatttcaataaaatgacaatcaaaggctatgatacatacatctttctgcagaggtatatgatcaaagtatttattaccataaatatatctttctgcagagttatatgatcgaagtatttattaccataaagaaaagcacaggctgcttgtgctgtatttaatctttgtttttttcctcccattagggttgttttataaaggtgatgaccattatagagtcagaaatgggagtcgttgcaggaatttcctttggagttgcttgcttccaagtaagtttttgtagttacttaggaaatatttcatccctcttgtaggtgtaagctagaagattttcacttttttttttttgagatggagtcttgctcggttgccaggctggaatgcagtggcgtcatctcagctccctgcaacctccacttcctgggttcaagcgattctcccacctcagcctcctgagtagctagaattacaggtgtgcgccaccatgcctggctaatttttttgtatttttagtagagttggggtttcaccatgttggccaggctgatcttgaacacctgacctcaagtgatccgccctcctcggcctcccaaagtgctgggattacaggcgtgagccactgcatgcagcgagattttcacttttaaggcttataagtttttgcttcaggggactggatagtgaggacatttttagggaagtcgcattttcacaaaactctcagttactggtcacagtataaaaatactttatttaggagaaatacctaatgtagatgatgggttgatgggtgcagcaaaccaccatggcacgtgtatacctatgtaacctgcacgttctgcacatgtatcccagaacttaaagtataattaaaaaaaagaagaaaaaaagtaagatttagaattaacttgtagcagtgcatatcttttgaaagcagttaactgtggaaagactcagtgccctcttagttatggcaactttccagtatcatagctcatgaaacaaaacattagataggaaccttggttctctctgcggtcagtcaagattctaaaatgttattaggatcttttctgggctgcaactgcctgatgagttgtatacaagttccaacctattaaaatttagatgatgccacccccacattccttatgcaccagttgtttggggttgattccacgttgtagatcaaattgtgtttcccaagttgtgtttcccactgtagcatgaagtttgttttgtggctctgaacgtttttttttatattaaacactagaaataagactaattcaagtttcgtcttaatatatttttaaagtagtaagcaaagctatatctaaatctatgctaatgcagtagccactagccacctttgaattgttataaattattaaataaaattaaaacctcagtttgctggagatttgaaatacttagtagccatgtggctgctgcctactatatcggacagtacagggattctagaacattttcattattgtagcattgctgtggatctttccagggaaatctctgccctcgttgatggagatttcacttgttaagatacttattgaaaaccatgtatttgttttttctgggaaatgagagtaagaaaagtttcttcaaaactcgtgactgaattttccttgagtgagtttgctggattttcctttggtgagagttgtgaaattctgggtcacagtggcaataaaacttcacttagattctttgaatgtgatctagatgctgcagagtattaaacataactctagaaaaactcaaggacgaaaattataagcgaattacaagtgagaggagaatatagtctgaggtgttcaagttcttttgtgtatgtatttaattttgttcctattttatttctagctgattggaatctttctcgcctactgcctctctcgtgccataacaaataaccagtatgagatagtgtaacccaatgtatctgtgggcctattcctctctacctttaaggtgcgttcattttggtcctcagctctgttagtgttgatatttattctagcctgtgtatgtgatgcatggactaagtttgccaagaacgtcttgtctagtaatatatttaaatctagctggtgctatgtaaaccctgtgtaggcaggttaggtctctatacacagggcatggtcagaaagtaatgacttagctacagcttatctatgcatgctctctacagttatgcaacagaagactccccgtgtgggtttatatatttacatacacatgtcagcctaaagatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctccta

SEQ ID NO: 4775 - DNA, 7083 bp, human
atactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagattgtactccacagagagatgcagacaaagtaaacaatgaagtaaggtgccttttaaaattttctatttggcaatatttgaagacttaactgaatgcaaaattgacccagtttttaattttttttttgagatagagtcttgctctgtcgcccaggctggagtgcagtggcgcgttctcggctcactgcaagctccgccttccaggttcacgccattctcctgcctcagcctctcgagtagctggaactacaggtgcccaccaccacgcctggctaattttttgtattttttagtagagacggggtttcactgtgttagccaggatggtctcaatctcctgaccttgtgatccacctgacttggcctcccaaagtgctgggattacaggcgtgagccactgcacctggccagtttttaatttttaaatataagctgaaatagatagggcgggtaagaattgagttcagacggccagcaagtaacacttttttgtttatttattatttagtatttttttttaaagacagtgtctctctctgtcacccagtctgaagtacagtgttgtgatcatagctcactggagccttgaactcctgggttcaagtgaagtaacacttttaaatatataatccagaaggtggaaataattgggaataattatttgttctgttgagaacatatggaagagaatagatttcaataaaatgacaatcaaaggctatgatacatacatctttctgcagaggtatatgatcaaagtatttattaccataaatatatctttctgcagagttatatgatcgaagtatttattaccataaagaaaagcacaggctgcttgtgctgtatttaatctttgtttttttcctcccattagggttgttttataaaggtgatgaccattatagagtcagaaatgggagtcgttgcaggaatttcctttggagttgcttgcttccaagtaagtttttgtagttacttaggaaatatttcatccctcttgtaggtgtaagctagaagattttcacttttttttttttgagatggagtcttgctcggttgccaggctggaatgcagtggcgtcatctcagctccctgcaacctccacttcctgggttcaagcgattctcccacctcagcctcctgagtagctagaattacaggtgtgcgccaccatgcctggctaatttttttgtatttttagtagagttggggtttcaccatgttggccaggctgatcttgaacacctgacctcaagtgatccgccctcctcggcctcccaaagtgctgggattacaggcgtgagccactgcatgcagcgagattttcacttttaaggcttataagtttttgcttcaggggactggatagtgaggacatttttagggaagtcgcattttcacaaaactctcagttactggtcacagtataaaaatactttatttaggagaaatacctaatgtagatgatgggttgatgggtgcagcaaaccaccatggcacgtgtatacctatgtaacctgcacgttctgcacatgtatcccagaacttaaagtataattaaaaaaaagaagaaaaaaagtaagatttagaattaacttgtagcagtgcatatcttttgaaagcagttaactgtggaaagactcagtgccctcttagttatggcaactttccagtatcatagctcatgaaacaaaacattagataggaaccttggttctctctgcggtcagtcaagattctaaaatgttattaggatcttttctgggctgcaactgcctgatgagttgtatacaagttccaacctattaaaatttagatgatgccacccccacattccttatgcaccagttgtttggggttgattccacgttgtagatcaaattgtgtttcccaagttgtgtttcccactgtagcatgaagtttgttttgtggctctgaacgtttttttttatattaaacactagaaataagactaattcaagtttcgtcttaatatatttttaaagtagtaagcaaagctatatctaaatctatgctaatgcagtagccactagccacctttgaattgttataaattattaaataaaattaaaacctcagtttgctggagatttgaaatacttagtagccatgtggctgctgcctactatatcggacagtacagggattctagaacattttcattattgtagcattgctgtggatctttccagggaaatctctgccctcgttgatggagatttcacttgttaagatacttattgaaaaccatgtatttgttttttctgggaaatgagagtaagaaaagtttcttcaaaactcgtgactgaattttccttgagtgagtttgctggattttcctttggtgagagttgtgaaattctgggtcacagtggcaataaaacttcacttagattctttgaatgtgatctagatgctgcagagtattaaacataactctagaaaaactcaaggacgaaaattataagcgaattacaagtgagaggagaatatagtctgaggtgttcaagttcttttgtgtatgtatttaattttgttcctattttatttctagctgattggaatctttctcgcctactgcctctctcgtgccataacaaataaccagtatgagatagtgtaacccaatgtatctgtgggcctattcctctctacctttaaggtgcgttcattttggtcctcagctctgttagtgttgatatttattctagcctgtgtatgtgatgcatggactaagtttgccaagaacgtcttgtctagtaatatatttaaatctagctggtgctatgtaaaccctgtgtaggcaggttaggtctctatacacagggcatggtcagaaagtaatgacttagctacagcttatctatgcatgctctctacagttatgcaacagaagactccccgtgtgggtttatatatttacatacacatgtcagcctaaagatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttcta

SEQ ID NO: 4776 - DNA, 4148 bp, human
gtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagattgtactccacagagagatgcagacaaagtaaacaatgaagtaaggtgccttttaaaattttctatttggcaatatttgaagacttaactgaatgcaaaattgacccagtttttaattttttttttgagatagagtcttgctctgtcgcccaggctggagtgcagtggcgcgttctcggctcactgcaagctccgccttccaggttcacgccattctcctgcctcagcctctcgagtagctggaactacaggtgcccaccaccacgcctggctaattttttgtattttttagtagagacggggtttcactgtgttagccaggatggtctcaatctcctgaccttgtgatccacctgacttggcctcccaaagtgctgggattacaggcgtgagccactgcacctggccagtttttaatttttaaatataagctgaaatagatagggcgggtaagaattgagttcagacggccagcaagtaacacttttttgtttatttattatttagtatttttttttaaagacagtgtctctctctgtcacccagtctgaagtacagtgttgtgatcatagctcactggagccttgaactcctgggttcaagtgaagtaacacttttaaatatataatccagaaggtggaaataattgggaataattatttgttctgttgagaacatatggaagagaatagatttcaataaaatgacaatcaaaggctatgatacatacatctttctgcagaggtatatgatcaaagtatttattaccataaatatatctttctgcagagttatatgatcgaagtatttattaccataaagaaaagcacaggctgcttgtgctgtatttaatctttgtttttttcctcccattagggttgttttataaaggtgatgaccatt

SEQ ID NO: 4777 - DNA, 6549 bp, human
agctcttcagtagtttctgaacatctagacggtaggatgtagaataggtaagtagaaatgcaaagcagatattgcagtaattgactaaagggctgggttaatgggagtgagtgtgtagttaagacagttatggtgttagagaaagaggtgaggaaggagggactttttactgagttgggattgaactggatattcagtagaagcagaaagtatgagtgaagttgagggtgggcagggactagggaataggacttgtttaattggggggttgatcatactgacctggtacagagcagaaaattcacattggaaaagcagtaggaaatcagttgagattgtattgggatgaggggcttggtagggatggagggaggctggaggtggcacaagggaggtctgacttaacagtgagcccttgtttatgtcatttcccttgcctgatgtctagcaatgaaaaacatttacacctaatcttgaaggttacaggaaattaattgggaaggggggctactaaatgttccatgtaaaacaagcagtaacaatacttaaagtattttccttttttcctacattgttggcatcaaattgtgtttctgtgctcagaaagagggagaaattaagaggttgaacaagaaaaagtactgaactctctgccttaccactctggggcaggtagggttacttcctaggtggctgggctattggagtgaaggcaaaagccaaactcaaccaaaaaaccccaagtgcaaggcagaattggggcaatcattgaggttcttaagcttcagaggctccgaggagtccttgttttaggttaaatgtctgtgcaacagcagtctttactcaggttactctgcgcagaggcagctgtacgtacaacagcagctatgtttcatcacaaagtgggccccatttctgatgaaagacacagaagttgcccaggtttagtcctaggcagcttacttggtctctttcaacctgtttcttcatctgtaaaatgaaggtgctaggtgtgtcaacctcataatagggttcttgtgatgtgtgcatacgaggtaatgtgtatcaagctcttagcaatagtggttggtatacagtcaatacttattatcacagtcattattaatactttaaagaatacatttatctagtggcctagggaaatacttcttaaattgccttaaacgggattagatgcccctttggtctgggtttgtacccaaacccaggcctaggtttgaactaaattgaatttctcggtttggtggcattgtgggggtggggagatggaagtgggtgtagcagagtaggaggcaatggtgcaaggtgttgtagccataggaatatgaatttccatgtcagcatttggtttaatttggcaccgagtgttattcaaacaaagcagcgttgtgagtggtagaggaagggagaggaggaaagtcaacacattcttggaaataagatgtggcttttgctttgctattttgttttttcttcagctacagacatatttctttgctcttgggctcacactgtaaatccctttcagtacatatctaagtttcagagaaacttctctttaagatgacaagaagttatcaagacttcccttgatccttgtttttagtataagaacccttcagttggggtcatttagcctagggagaaatctttgcatatacttagacacccccctccaccatgttgaatatttggtatttcctaacgactttacctcaaagtgtttgaaggtgtatgtagatgtatcgtttatccattctctccatgtatttgtgtattaggcctttcaaattttagtaaaaattttagtataaagcctggcaatgcaataattaattttccaacagttgctgccttgcacctcagacgtctggcaagatgttataggaactggtcctaggtcaatattcgaagcacagggaagctctgtgtgaccaagtcaatggaactttcctgtgttctggtcctgaggtgtatgtttaaagcaacgtttcaagcagaaaagtttgagtattcatctctcctccacaaatgcaggtctttttgcaatggcaatagagtaaatagccacttgtgatattaagcttgtgtcaatgatgaagggttggattgcatagggaactgatacagccttctaaccccgttcctctagagataacacaaactcacttaacactcagtctctgccttcaaagagctgacgctttagttgagaaatcagaccttaacgcacctcctgtgttgtaacaacatagaccaatatattcacaatatataacattaggttttaatctctctgtaatcagctgggttttgatgggaaaaaccaggtggctggaatgtacagtgcctttctgttttaacatttaagaggaggtcacactcaccagggatttttccattgcactctctctttttaaaagtttacagcgaatagctgaacttacatttcactattatgtaaaaatactttccctcaactttccaattacttaggggataaaaaaggagaggaatactggggttttgcaaagtcctgcaggtaaattctaaagtcattattatctttaatacctagcttagaaattctttcaacaagtggtgattattttcctccattcacatctccccttcctaacccataaaacaatgttcacaaattgaaaagcacacaagtgagaaaaaaatcagcctaattccaccagaggtaaatttcactgttcctttcagtttttgtctaagcacacgtgactgtatgtattgctttgcaatccgctttctttttgcaaatatatttcttgtgggtattttcccatgtattttcttaggtcgcttttaacctcttcattcttttccttctctctagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagatt

SEQ ID NO: 4778 - DNA, 57031 bp, human
agtcaccttttcgtgggttcctctcacagcgctcggccgtcgagcggggtcgctaacccgcactctcttcggacctacgacatcgcggcttctctggcgttggccagtcagccacaggtaaaggctggaggctggttggctggagtcctgcctcagtgggctccctctgcgcttggggctggggacctggctgtgtgctgtggagctgctttatattgccgctcttcaagcaggctgtgagagatctggtactggaggagggtccccgagatctcagaaggggcacagaatgcttctgtctcctgtgttggtttgtaatggggcagaaaaaggtgttcctccaacccttaacattgaatgaggtgggatttggggtggtgaaatcatttggttagaattctggtggcttgaaaagtggtgactttctaatcaagcttttcttcccccagtaccctgcttcttcaggattagaggacgtaaaattccagagtactgtgcttggcagggttgaccctagaccttgtatatttgtggcaaaaatgagtcttctgtacatcctggacctcctatatttaactggcttattttctgctctttaagctccccacccccacctctcataaatctattaatattgaggtattaatgacttaagacttttgtcgctgtgggaacaatgtttaatgcagagacgtggccttgatgaagttttctgcgtttttggttgtttggtttttagcaccctagtagaaaagcaccaccaacttggcttgtgaggccctttttgggcagaggatgaacatttctggtaacacaatttcaggtgtctcactcttggtcagagcagtgaaatggagctggaggcctgttctggggtaattgatctgtgagtatatgtagcattctggctctctgagcttgttaggctctggttgttaggctccattgagctggacactgtgataagttctttacataaaaatgcaatcctcacaataactctatacagtaggtgctacagttataaccatattatgatgaaaaagagactgagaagttaagtgccttgccctcaaaatctcggaggcagagcttgtgttcctatcctgtcacaccacctctgttgtcttagatgttgggaacactgaatagctcatggatgaggactaagtgattaaaaaattgtcttccaagcccaagtatatgtttttctccttgcttccaccttagatgcactgccgagactatggactacttaccttactgatgtcttacccacttcatttccaacatgggccagttgccacgttaccactataagtacacatccctgagtgtaattagatgaatgaaatctcccgggttttcagctctgtggtaattgtcctgaagttaggggagggtaaccctggattctagggatgtgtgcctgactcaacttcttcctctcctgctggctaggggagaaatgagggagtggtaagtgatatggatttcctgacagccataccagagagcctgagggtgatcgtgtgctagttttgtcatgggatggatggagtaccatagacaaggataggaagaaaatgtcctccctattcccatctctgggactttgctcaaactgttcctttttttcttcctaaaaagctaactttcctccctcattccccctcccctgacattaattcctatccatccctcaagattgagttctaaagtcacctcctttggaacggccttactgaacacatacttcttcccccaagcagaattgccagttatcctgtgtcctaaagcactttgtttacacctcagtaaagcccttaacactgcttagttgtttttccacctggaaggctgtaagttctctaagggcaaggtctggatctcggagctccctttgtcttaaatataagatgttggcaaatatttgtgccagtaaccggacataccatgccattccttcaaggggctgaggtgtagtgatggtggggttgaggtacagaagacaccttcctgaggcacttgaaataccacagctaggaatttgccctgaccaccctatttaaacgtgtaatcccttccctgaacattccatatgccctttccctaccttattacattgttcttgcttattgtctgccctcccactccctcacccaccataacataaacaccctgtgggcagggattgctgtctgttgtattcaccagtagactcttggacccagaacagtccttggtacatcataggtgcatactaatatttgttaatgaattaatggcattgccattctaggaatttggcactcttggagttaggcactcctggacctgaaactaagcctacccagtttgtcgccctacaggtgtaagtttgccccaggcccaaaactcagctttacttctgctgatttttgctttgagattgcattcctgatgccaactttgacctagttggaagtacttcctctctcttacttttttttttttttgaggcagagtttcgctgtgtcgcccaggctagagtacagtggcgcgatcttggctcactgcaagctctgcctcctgggttcatgccattctcctgcctcagccttctgagtagctggaactacaggcgcccgccaccatgcccggctaactttttgtgtttttagtagagacgggatttcaccgtgttagccaggatggtctcgatcttctgacctcgtgatctgccctcctcggcctcccaaagtgctgggattacaggcgtgagccaccgctcctggcctctctattttttaaaagtatgagtctctgggtggaaatctctaaagtttaaaagtggaaatgtaaaaatgttgtgcttcttgttggtaggaagggggactgcactgggaggaaggggtgtggattgtcagatgtcttgaggcttttcaggcttctcgcaagatcaataagaggctggagaaagttactgtgcaatggggaagtgaacagctcaaaagaataacggatggcacaaattaggcttctggtttcaagttacccatagccttttaggtatgaggtggttattggattatggaactttatggaaaagccgtagctgagtgctatttgtgttgtacttaactagttttctaccaggatgactgtgcagtctggagaaaccactgtgtaacataaaagaaaaaagtgctattctgtttaaaagtgttttgaaatgttcagaaaggaagaggccagaatctcttagaagacagacttggaaggagttgggcccttcaaaaggtggtaaatatgtgattctcatcatttaatatatgttaacttatttgaaactcaaatttgtacaaaaagctgaccagcttctttttctactaaatttgtctccccagcctttgaacattgcagtgacctggggttcagtccctggacttttctccatctaaaatcttcacagaggctctcatccagctgcatggctttgaagaacatctgtctagactgttgtcactcccaaatttatgtttgttacccaggcctttcttctaagctgcagcctcatatatccaatgacctatttgacatctctgcttgcctatcagatagacctctcaaatgtaacgtggccaaaacggcactcccgattgcccttgtattcccaccctcttccctcagcactccctgtctcagtaaaatgtcaccatcatccattcagttgctcaaaccaagaacctaagatcacccttgattcttctttttctatcactgctctccacccaatttaattcatgagggagtcctgctgacctgatcttcagactgtatcatgtgttctgccacacgtctccatctcctctgcctgtcaccctagtccaagccaccacacgtctgccacaaacattcttgcataatgctcaaggatatatatatacacaagtatttttgtgggatagctttctaataggagaattgttaggtcaaaggacatatacattaaacaatttaaataggcatcaccagagtgacatctaagagggtttaccctttcaccattgcgagtggttttcctcctgcccttgctgaggatggatgacgcttttaattttttccaatctgataggtgaaaaatagtatctaactgatttaacttggcatttctctgatcactagtgtggctgagcatcttttcatttgtgctagctatttgtatttttccaagacttgctcctttatatcctttgcacatttatcttttgggttatatatttgatttgtttgtaagaacactatatttattagttatatttacccattgcctattatatagtgcaagtttttttctctctagtctgtcatatgtcataactttgttcatgatgtgtacccctctcgtaatcagataaaacccactataaaacatttaaaaaacacgttcattagatttggcaattaggaggccaatgacaacatcagtgcagcaggaggagagaaggcagatcgtagagggttgggcagtgaggactgagaaggactgataaaaaatatggtagatacacatggacatggagagtgggatgatagacaatggagactcagaagggtgaggggtgggagaagggtagatgatgagaaatttcttaatgggtacaatgtatgttattcaggttatagataccctaaagtctctgacttaaccactgcatatgtaacaaaattgcatgtgtaccccataaatttatataattaaaaacatgtagtatatacattgaagaagcttggctatgatgggaaggagagagtgttccttatagacagtaaggcacaggggataaaaaggctgttttatttaattttgttttactttaaatataagagatagatgagcccatttatgtgcagatggcatacagcttgatgatgcaaggtccccgagaaagtcagagggtgggagtgccagagtgaaagaggagaaaagactagccttagagaaaaagtggtggctcttccattgaaacaagaggattcaccaatcctcttggtaaaaactatggagaaggaagtacctgtggagggacaggattttgagagagcccctccgcccccaacaagagagtgaaaggttcaccagagagtaaagaaggcaagaatggtgaagggttggaatagcatttgagagagacgaaaagaggagttctttaggggcatatcatccaggttatgtatgtgtatttcaaaatatcatgctgtacaccataaatagacacaatttttgtcaagtatacctccataaaactggaaaaaagttttaaaatggcttgggtaacttgaatttgtctctgcctcaagtcgcagaaccctgtatccattctgtctggcagcactcatcagaccaggaacagagtgtggacaatctagtatggggaattttttccgggtggccgtgacagaaatagggagagggctggagattggatggccctggcagaagaatagttgaaatgatggaccactgtggctttcatattcatatctgtgactatctaaacctaacttgaccttgagtaatttttaagaagtagaaaatttccatggcatctacactgcttcttgtttgtagctctatcgattcaggcatcagaataccattagtatcagtgtctttaaactcatcagaaagcgtgatttgatttactgagggcctatgttgtgccatgctctgtgttgatttactgaggatttacgttgcaccaactgagagcctacagtcaggatcctacaatgtagatttatccatctatccatccatcaacccagctagatgcttgaggtatggctgagaagaaggtagacaatggccatttttctcctggaacttatttcggcaggggaagtgtatattaaatattgtatcacataattttttaattacaattgtgataagttctgtgaagttcagttttcttagaaatcagattgtcacattgctttttaacaggccttactaatttacatttgccaacaaaatatgagaatatctcttaaatcctttttaaaaactgaaaattgtctttctgaaattttgctgaattaataagcaaacataaaaaaatctttattgccagtaagagtgaaactttttctttttgatgtgtattggccatgtgatttttcccctttaagaattatctattcacgctctctgtctattggatacttacctcttcttgtttttaatagatctctcattccatgtttgaaaccattagctacacttctctcctttctctcttagccctggtgaccttaaaatattttcccctagtctctacggccattcccttttgatctcctgtgaaatttttttcttacctagaagtgttgctgtgcttagggatgggactacatttttattacttgactcaataaaaggtaacatataaatcttctgttcctgcttatcccactctccagaggtaacaatgttaagattgtatttctttctagacatttttccattcatccatgatccaatctgtctaaaatgtaaacaaataaaaatggaatcataatatatatgatttgcaatttttttaatttaatatgctttcagtgtcagtatatatagaactacagtaccttcttctttttttttttttcttttttcttttttttttttattgatcattcttgggtgtttctcgcagagggggatttggcagggtcacaggacaatagtggagggaaggtcagcagataaacaagtgaacagaggcctctggttttcctaggccagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacatggcaaccatccgatttctcaatcttttccccacctttcccccctttctattccacaaaaccaccattgtcatcatggcccgttctcaatgagctgttgggtacacctcccagacggggtggtggccgggcagaggggctcctcacttcccagtaggggcggccgggcagaggcgcccctcacctcccggatggggcggctggccgggcggggcgctgaccccccccacctccctcctggacggggcggctggccgggcgggggagctgatgacccccccacctccctcccggacggggcggctggccgtgtggggggctgaccccccccacctccctcccggacggggcggctggccgggcagaggggctcctcacttcccagcaggggcggccgggcagaggcgcccctcacctcccggaacgggcggctggctgggcggggggctgaccccccccacctccctcccggacggggcggctggccgggcggggggctgacccccccacctccctccctgacggggcggctggcctggcgggggctgaccccccacctccctcccggacagggtggctggcctggcgggggctgacccccacctccctcccggacggggtggctgccaggcggagacgctcctcacttcccagacggggtggctgccgggcggagggactcctcacttctcagacggtgcggctgccgggcggaggggctcctcacttctcagacggggcggccgggcagagacgctcctcacatcccagacggggcggcagggcagaggcgctccccacatctcagacgatgggcggccgggcagagacgctcctcactgcctagatgggatggcggccgggatgaggcgctcctcacttcctagatgggatggcggccaggcagagacactcctcacttcccagatggggtggcggccgggcagaggctgcaatctcggcactttgggaggccaagggaggcggctgggaggtggaggttgtagtgagccgagatcacgctactgcactccagcctgggcactattgagcactgagtgaacgacactccgtctgcaatcccagcacctcgggaagccaaggctggcggatcactcgtggttaggagctggagaccagcctggccaacacagcgaaatcccatctccaccaaaaaaatacgaaaaccagtcaggcgtggcggcgcgcgcctgcgatcgcaggcactcggcaggctgaggcaggagaatcaggcagggaggttgcagtgagccgagatggcagcagtacagtccagcttcacctctgcatcagagggagaccgtaccttcttctttttaacaaaggcacaatattccctaatatgtgtgtacaataactagtcagtttcctttgatggatgtttatgttctttaatttttttttttttgctgtttcaaatattgagcatcctcagaatatatatttgtgaatttacttgaatatcagcagaataagtttctcaaaatgaaatggctatgttaaaaatatggtcagtggtactaaagatccagagaaatctaggaagaccaagaactgtctattggatttaggaagttcttggtgaccttagagcaatttcagagaactgtgaggcagaaagctaaactatggtgggttgagaaatgattggagagatgaggaagtgaaggcagtgattatgtacaattccttagagaaatctgtctggctttgaagagcagagaaagggtagtagcaaggaaggagttgagattgaggacctgttatttatttatttatttatttatttaggaaggacttgagtttctttaaaggctggtgggaaggagggactaattaatagagcaaaatccttggaaggcaaagtccttatgccagatgggaggggatccagattgaggtagaggattatcctcaataggcatagatgaaagtaggttcatagatttggcggcaggaacttgtctgatggtatttctatttctctatgatataatagttaaggccaacctcttagagcaggggttaagatgggacaaggtttgagttagatatttgtggtatttgaagaaggtttgaaatagttattgtggagaacaggagagcagcctagggaagcatagttgcagtgccaggcagggttaagatgagcttggtgaccaagaattcatatggataataatctaccagagtgtgattttttttttctccagtagatctcaggagtccttgtgcatgcataaagtataacagttgggcttagaagagctatggttttttaaatcagatatttgcagtgaaattatgcattattgaggatattgacaagagtgcagttgaaacaatagaattggctgggtgcggtggctcacaccagtaatcccagcactttgggaggctgaggcgggtggatcacctgaggttaggagctcgagaccagtctggccaacatggtgaaaccccatctctactaaaaatacaaaaattagccgggcatggtggcgcacacctgtaatcccagctacttgggaggctgaggcaggagaatcgcttgaatccaggaggcagtggttgcagtgagccaagatcatgccactgcactccagccagagcaatagagaaaaagtctcagaaaaaaaaaagagaaagaaacaataaaatttaaatgttattgggaaggaagtaaagatgggaaggagctgaggaggtgaaagcagaagggtctatggaagactgcccccatccaagaaatctgagaacaggaatggggctagttggggggctcattggctgaataggctagaagcacagcaggttgtggtcagagagggggtgttgaatcagtgatatcaaaggtggagaagtcctagatgataagctcttgggtgtggctgaatatgatatatggtattcttgatgccagctcattcattcaacaaatatttattttgtgcatattatgatccaggcagtgctctaggcaccaaaggtacagaaatgaacaaaacaaagtcccttctgtcatacagcttacaatctagtgggggagattatttttataaactaaaagaacatccttattgatgtgctgattcctgtatgtgtagctttatttgtaactaatgataataccaggatcaaatatttacatatatgggggctaagaaggtccatctaggcattttgagtatcttgctttatctcaagttatacttactgaattatgaaaactcatacctcttttccccttagaactttttaaggtatttttacttactatgtcagtattgaaaataaacaaatatatacaaatctaatttgaatatttcattggttttaattttttatactgtattttttaaaaatattaggatattgcttcaagctgtagaccagatgttgataatgcatgtactaatcttgctctagggatttgatgtaatgtgtaaagtaattatggttaagcagtttaggagggaaagagggcttgtaataagttaatattttatgtttatttttatattattctccaatttattttattatttatacctaccttttaatgtacatatggtcatgtatatatttattaatattttatttgaaagaaataagcatttatttggcatcttataggcctcaagtaacactttaaaattacctgccacgtatgcaattcaatttaaattcaactacaggttattttttattgttttaaggtttctgtggccatagccagatcacagcatccctaaaattaaaaagaaaccaaatgcatgaaatcacagttatgtgtgagcatgggctggattagtcatgaaccatgatgatttcacatttaaggggactgtgtgggtaatttttaggtgacatggtctgcaagaaataatcagatgccagttagagttcagtttagaaatccccaccatctgtgatcccagcaggagaagagggtcttccctgcgggagtgctgcattatcaaagcttgttgactaaggaaagataatagtgttctgcgtgggaggtgatgaggcttattgaaaaataacaatgtgtcagctctcactggacttaaaaatgttttgtacatataaatgacctagattttaaaacagtccattcttttagttggggattttagattttttaaaaatctaaaaaatggggctgtcaaggaaggggcttttggcagagaagagggtaaactggccatcctgcacccatcagcctatgaggctcttgtgtctggctcatgttagaggaagcttcaaatgtagattttgaaagctggaaagctaaatgggatttgttttaatatatgtattttccctgttgccaagtagggtgtttggacacatggtctttataatattttagagttacttctatgtatcacatttatggaaatctgccttctaggattggtggtgggtttaaggcaccttctagagttgctgaggagcaggggacaaacgtgtagaatcatgaaggaccacatttccacatatccaaaacaaccattctgcaggagaaatgaatatatagtattaagatatctgacttccttctgggacttgttttagagttgtatatattattttaagtgggaatttctacaaaccatttatgaacagaatttgttggtattgaaaggtagctatgtggattccatctggaggaaattgtccccacatatgattctaaaagctaacaaaagaggcattttagttactaccactgccttcttccaccctgctgcccacccccaccccctgccccaccattatgcacctgccatcttttaggatggatgtcctggatgaggggaatgagttattgtcttgcgtataatgttgctttgagctagagttgctctggcgtgttacacatattgcaggaggaggtcaggggtctgggaaagtaagccagactgagggcctctcaaacattgtgtttgttattagctgaagacttttagaaaccccacctcaagttcctgaggttgatgttcccttttccaaaaatcaccatatagagcaatattgccagaatatgaagagacagtataatgtaatgtaacggttaagagcttggactctggaaccagacggcctgggtccaaaaaccagactgtcacagggcatgtgaccttgagcaagttatttgctcaatctgtgcctcactttcctcatttgtaaagtggacataataatttagtacctacctcatagtgtgattgtgaggactaaataaagtgcttagaagagtgcatggtacataataaacattatagaagtgttaactatcattgtcatcatcttcatcagttggtggatatcttaaaaggagtgaaaaccggccaggtgagatggctaatgcctgtaatcccagcacgttgggaggccgagatgggcagatcacgaggtcaggcatttgagaccagcctggccaacatggtgaaaccctgtctctactaaaaatacaaaaattagccgggtgtgatggcacacacctgtaatcccagctactgggaggctgaggcaggagaatcccttgaacccaggaggcggaggttgaggtgagctgagatggcgctgcctaactccagcctgggcaacagagtgagactccatctcacaaaaaaaaaaaaaaaaggagtgaaaagcacaaaatgcctcagcacatgcaaactctacttttgtagaatctattttgaaaaggatcgtagggagccaaaaccttactgcaaaatcagaattttgtaaaattaagagctagttgtaaatttctcattgttagggaaaaatacagctttgctcccatacaacttttgagaatggatttgtgaaggcaggccctaggggattttatgtgaggcatagatgtgctccatggatggacaggtgagggtctagaccccagctgactcctaggaagcctcagttgccctttggttttggagccttgatactgactctaccagtttgtctccactcctatttttcttctttttgatcctatttttaaaatttatgatattttttgatgttttatgaatctttgtaagtcactttaaatcctgtctggaacagtgtataaataaatatcctttaaactgatcatatctaattactaacatttgcttcatatttatgcttgtcagcctccctccatgcagagaggtacggtgaccttccatctaggcaagaatactgattagatttctcaaatttcatagaaagatgtcaaaactgccatatgctcatatattttccaaagcatatggttaataataattaaaactaaacagctaccaatattgggtgcttactctaggccaggcactatgctatgccttttactcatgatgcatgcttgaatcctcaaagccataggcaggagctcttattattaatcctcatttttacaaatggggaaacagactcaaggaggttaaataacttgcccaaagttaattcagggaaaaagcaaagctgtgattttaacccaggcagctcagatccagtgcttttaagcacaattctatgctatactgtccttaattagaaatctagcacatcagaactccaagtcctagtataagaggccgtacttgtgttacagaacattcacaggtcctgcagattttctctccgtgtaatgtctttaatatgcccctttccatctctagtgccactgccctctactcttggctcttgttatctttcccctggatttatgccacagcctcctcaaatccatagtctgcaaaattgtcagtgtgccctaacaagtccttgctttacataaaactcttcaatgatttctgttgtcaaaggctaattagccgtgtttttgcgcgtagcatatggagcacccgccagccacacatgatgtgattccccacctgcctcttccgcattctcccttacaatttaaaccaaccagcatcattgtattacttgctcataccacgttgctttatgcctccatgcttttgtaagtgctacgcactttgcctggaaagccctcgttctcctgcttatccagctgaaaaacattaatttacaatcagttcatgtgctactgctggatattctctttctagttccctttccccaagctgaattatgtgccctcccttggtattcttataatatctcatgcatatatttctttggttaccatgttttttttttaggattatttaagtgtctctgttactaaactgtgaactctgtgggcatggactagctctgttcttttcttcttagccagctagtgtaccgcttagcacatagttggccctcctaactagtgagcattctgtaacagtgcagaatacagagctctaggacagggaaagaagtaagatttggaaggcctgaaactgtgcacacattcaaagataattaccaggacagcagaaggagctcttgcagaaaaatctttggggccaggtaatttacattatttaacccaagagccagaaaggatgtggggagatgggagctggggtctgaatccaaagggaactttgaaacttctaagaagccagacttagcagctttataaattgaaacttccttgaatttgtctgagtagcctggaataggtatctaagacagttacattttaataagaatatttatagttttctaggagagacatcaccctaaaattgaaaggggcagttgatacaataaccaacacaatatcccaaagcaattattttattgactgtaagcaatgttgtatgctcatgcaaatgttaccagtaagatgttatccattggtatttttgtgcataggtggctggatccagacaaggggattttaggaagccctgcatccctggaagctttcttttctacttgagtttttttcttttttttttttttttttttaagttttgcagaccaccatatactctggatttggtttcatttttccgtgctctaaaatcaacttttttttttttttttttgagatggagttttgctcttgttgcccaggctggagtgcagtggtgtgatctcagctcaccgcaacctctgcctctcaggttcacgtgattcttctgcctcagccttcccgagtagctgggattacaggcatgcaccaccatgccagggtaattttgtatttttagtagagacggagtttctccgtgttggtcaggctggtcttgaactcccaacctcaggtgatccgcccgcctcggcctcccaaagtgctgagattacagacgtgagccaccgctcccggccaaatcaactcttttacctttagattatcaaataactagtcccccgcccatcggtactagattttgctaccttttagggctatgcttcacccatgttctggaaacccacacaaataatacgtattagttttgacagtactttagcttgatctgctttagatgctgtcattgcctttgtcacaattagttaatagagtccactttttttttttttttttttttgagagagagagaaaaggtcttattctgtcacccaggctggagtgcagtggcccaatcttggctcactgtagccttgacctcccgggctcaggtgatcctcccacctcagccttccaagtagctgggattacaggcacataccaccacacctggctaatttgtgtgtgtgtctgtgtctgtgtgtgtgtagagagatggggtttcaccgtgtagtccaggctggtctcaaactcctgggctcaagagatcctcccacctcggcttcacaaattgctaggatgagccacctcacctagcctagagtccacttttgaatgtgtcttatgacagcaaaaattcttattcattatgctgtactacttgcataagagcaactgcattacaatcatcagaatgatttattctttcctaattaacatacatcatatctctatgcaagtagaatcatgaaaatatatggcaatttgtagaatagtttcccttaaccagcctttaagtaaaggacttcctagcttttttgattactcacctttatcaccccaaatttttatcactcctaaaataagtatttataaactacattatttaccactgtattggtcatatattataaagcatgcacaggccaggtgtggtgtctcatgcctgtaatcccagccctttgggaggccgaggcaggaggatcacttgagtctaagagttcgagaccagcctgggaaacatggtgaaaccccatctctacaaaaaataaaaacaaagtagccaggtgtggtggcttgtgcctgcaatcccagctactggggaggctgaggtgggagaattgcttgagtccaggaggtcaaggctacactgagctacgattgtgccgctgcactccagcttgggtgacagagtgagactctgtctcaaagaaaaagcacaaaaatggaaataaagaaggatgagagattaaatgaacttttaaaaaataattctaatatttattaatggtacaataacctttgctctcattttgatgaggccagtgacattaaatgtgcttcatttaaacaaaattttggtttatgatacagctacttgaacatctgattctaacttctgtttatttttatacttgattttaatgactgatgcctcacaaagtatatacattttaaaataaaagaagtatattgtttggatgcacttactaaataatcatactcatattacagttccaggcaccagttatgcaaacattttattgctgttcctgaacctgctgtcttttatgtttttgacaaattgaaaagttaaaacgtgaaacatcttttagataacaaaactgtgtagtaagggaaatatttcaaacctactctgtattgtttattctctattaaaaaaccttggccaggcacggtggctcacgcctgtaatccccgcactttgggaggctgaggtgggcagatcacgaggtcaggagatcgagaccatcctggctaacacggtgaaaccctgtctctactagaaatacaaaaaattagccgggtgtggtggcgggtgcctgtagtcccagctactcgggaggctgaggcaggagaatggcgtgaacccaggaggcggagcttgcagtgagccaagatcgtgccactgcactccagcctgggcaacagcaagactccatctcaaaaaaaaaaaaaaatcttgacataaaatattttagtgtttcaattaatttaaaggctcctagtgtcttgtaggtattctgggattggaaaacatgattacaagaagaaagtttagttacatttaatattaaaatgtttaaaaacattttattgaactacaatagacaaattatatataaagtatacaatttgacaaattttgacatctgtatatatccatgaaactatcaccagaattaagatattgaacatctatcacctccaaaagtttccttgtgccatgttgtaatccttccttcttgtccctgtgtgctattaccctccttacccccgtcaactcctgaaaccactgattctgttttctgacactatgtattttctagaattttatataaatgaaatcatacagtgttttttttttgcctgacttatttcagtcagcataattattttgagattcgttcatgttgctatgtgtatcagtagttcattcttctctattgctaagtagtattccattgcatgggtatactacaatttgtttatccatttacctcttagtaggcatttgggctgtttccagatttgggctattaccaataatgctgttaacatttccatgcaaatctgtgtaggcatatgctttttttttttcccccttttgaggcaaagtctcactctgttgcccaggctggagtgcagtggcgcaatcttggctcactgcaacctccacctcccaggttcaagcgattctcccacctcagcctcccaagtaactgggattacaggcatgcaccaccacacccagctaagttttgtttttgttttcttttgagacggagtttccctcttgttgcccaggctggagtatagtggcacgatctcagctcactgcaaccaccacctccctggttcaagctattctcctgcctcagcctcccaagtagctgggattacaggtgcctgccaccacacctgggtaattttttgtatttttagtagagacggggtttcaccatgttgatcggctggcttcaaattcctgacctcaagcgatccgcccaccttggcctcccaaagtgctgggattgtgggtgtgagccaccacgtccggcctacgtatgcttttgcttttcttggataaataccaaaagtggaaagcctgggtcatatgggagatatatgtttaactttttaagaaactgctaagctgttttccaatatggctataccatttcacattcccactgtagtgtatgagagttccagttgcttcaaatgccggccaacatttggtgcattttaaattttggtcattctaataagtatgtagtgatatctcattgtggttttagtttgcatttccctaatgattaatgatgttgatcatgttttcatgtgtttatttgctatttgtatatcttctttggtgatatgtttattcatatcttttgtctattcatatcattgtctattttttaaatttgtgtttttaaaaatattgtagagttctgagagttctttatatatgctggatataagtccttatcagatatactagttgcaaatattttcttccagtatactgcttatctttttattttctaataaagttcttacaaagcagaggttttaaattttgatgaagcctaatttatcaagttctggatcacgttttacgtgtcatgtcagaaatgcttgctttttttgtttcatatggatatctagtttttccagcactacttgttgaaaagactgccatttctccactaaacttcccttaacctttatttaaaaaatcaagtgactataaacatgagggcttatttccatactctctattctgttcgtttatttgtctgtcttcctgcccagtaccacattgacttgattactgtggatttatagtgtctcttaaaatcaggttaagtttccgctttgttctaccatatgttttgaacctcacaatatatcgttatttttcctttaaacggtcgattatattttaaaagagatttaaataataagaaaaaagtatttttacctacattgttaccattgcatgtgctctgtatccctttttgtaaacctatatttctgtgcagtaccattttctttctgcttcaaggacttcctttaacactttttatagtgcaggtctgctggtgattaattctttcaacttttgcatgtctgaaaaagtctttatttcacctctgtttttgaatgatatcttgctgggtgtagaattctatctaggttgatggttgttttttttctttcagtattttagagaggttgttctgtctttacacttgcattgattccaatgataaatttgcttttatcattatctttgttcatctgtatatatataatgtgtccttccccaagaccccaaccccaccccaccccaccactctagcttcttttaagattttcccattgtttctggttttaagcaatttatggtgtgccacatggtatatttttctttatgtttctggtgctttatgttcatagagcttcttggatctgtgagtttatagtgttcaccaaatttgggccattatttttggtgacatcaatgacatgtatagaaggtagcttgatgttgtcccatagctcattaattcctttttctttttttcagttttttctgtgttccattttgaataatttctattgctatgtcttcaagttcttaactcttttctactgtaatgtccaatttgctgttaatcccaacgagtgtgtttttcatctcagacattgtaccttttatccataggtttgatttgagtctttttacatctcccatgtcccctgcctagctttttgaacatatagaatgcagttataataactgctttgatgactttgtttactaattctaacatttgtgtcagttcttggtctttttgattgatttttctcattattatggatcatattttcttgcttttttgcatgcctgttagttttttactgggtaccaaatattatgaatttgaccttgttgagtactgcatatttttgtattactataagtatacttgctctctgttctgggatgcccttaaattacttggatacagagtgaccctttcaggttttgctgtttagatttgttaggcaggaccagagcagtgcataatctgggctatttcccactactgaggcaagacccttctgagtccttcagctagtgtcccgtgaatcatgacgttttccaatttggctggcggaaacaggcactattcttagccctgtgtgagtgacaggcattgttcttttgaatcctttcaggtagttctttccctggcctagagtaatttcctcacaggcataccatgggctaatcagtcctttgctaaacacttgagtgaaaccttctgcaggcctctgaagatctctttctctttctgtggagctctctcaggtcctctgtcctatgaactccagctacctggtttttttcccagactctcagctctgtctccagaactcagggagttcactaggctctacctgggttcttcctttctgtaccattatctggaaattctcttaagacagtaagctgggaaaatcaaagggctcaccttatgtgttttccatctcagaaatcataatccttcattgcctgatgttcagtgatttgaaaaccattgtttcatgtatttggtacatttgttgttgttgttattgtttcaggcagggtggaaattcattccaccttgacattttataatctccaattatgaccaattaaaatttgtagcccaatttaaattctcatctttcgaaaaaagtgtagacaccatcacatttcttgacgtagctaaatcagttctgaatacccatgttcaaaagtatacagaatctggcatgcagcagtataaatctcacatcagtataaaactcattgatcagtttcggtgtaaaacatagtatcattttaaaaagagcagtttaattcaggcttcttggttaaatgaatatattttgaaagactctggttcactttttcatgttcagtgaggtattgtccattgtccttagcctaaacagcaaaatacttttattacatcactttggcaggatatgataatccattagaatgtatttgcaaaaccatcatataattactacttataactttagagaataatttaatatcagttcagccttttggcccttgagcatgggtcaatttttaagaaaatcttctgtcatctataaggctgtcagcatggttcctcacttcaaaaacagtggcctgtgattaatgcattaaaattaatcactataaattcatccatgtacccaaaaactacttgtaccccaaaagctattgaaataaaaaaatttaaagaacaataacaatagcctgaaactttaactgacgtctagacagtttaactcacaattcatctgcattctttaaaagaaaataaatgtcattttctaagacctagttaagtccgaaagcacaaatgaacatatacaaactgacaaaaataggtaacacttagcattctttgtgttctcattactttaagcactttacgtattttaaaaactcatttaatctttataaaaacaagccccaaaggataggtacaatttttatcttcattttgcaagtgaggaaattgaggtactgagaggattagtaacttacccaaggtcacacagctagtaaatgtggaagttgggattcaagttcaggcagtctggctcaattccaagctttttgtttgtttgttttatggacacagagtctcactctgtcgcccaggctggagtgcagttgcaccatcttggctcactgcaacttccgcctcccaggttcgagccattctctgcctcagcgtcctgagtatctgggactacaggcgcaagccaccatgcctggctaatttttttttttttttgtattttttgtagagacagggtttcaccatgttggccaggctggcctcaaactcctggcctcaagtgatccacccgccttagcctcccaaaatgctgggattgcaggtgtgagccacccacctggcccagagtccaagcttttaaccacagctcacacactgcctcaggaaaacaaaaacatttttctctcagctctattacagctcttcaatttccatgggtttaagtttaaacatgtaaacacagatagatttctgggtaaagacattcactagacttttgttgaactcatactgtgtgtcacacactgtgccaagctcctggggctatgatatccagatatagtacctaccttcaaagaggttacgtctggtagatgtttctagtttgagcataagtaccatatattaccatcttcacttttatgtgtggcctgcatgcaacacagcaaaatctgttgtatttgctgtccagggcagggacattacttgtgtcttcctaattcacatcagttttcattttgggaacaccaatgattacttttaatctgagtactattcttacaaggaattctatattttagtcatctttttaatattctagtctcatgcccaaggtcatatagctaaaaatagcagagctaggatttgaacccaagtctgtctttcaccactattttcattattctatgcttcctgtcaagttttgcctagcttttcatttttaaaattggtctttagaatttgaaataatttgagatagctcacccatccccttcttgaaaaccagttgtgttagtgtttattttcattcattgttattatttctcaatcattaggattaggatatagactggatatatctagttggatatggaattctacatatgtcctttagatcaagcttattgtgttgttcaccttgtctacatatttactaatttttcatctgttatactatcagtaattgagagaggtatggtaacttcccatttttatggtagatttagtttttcctttggttttgtaagtatttgcattaacatattatcctcattttttagtagtaaatatgtataattgctaagtaagccatcttttcttttttttaattttttttattatactttaagttctgggataccagaatgtgcaggtttgttacataggtatacacgtgccatggtggtttcctgcacccatcaacccgtcatctacattaggtatttctcctaatgctatccctcccctagccccccacccccgacaggccccggtgtatgatgttcccctccctgtgtccatgtgttctcgttgttcaactcccgcttatgagagaacatgcggtgtttggttttctgttcttgtgatagtttgctgagaatgatacaaaccaccttttctaaaatatatttttatgggcatgggtcccacaaggatgctatattaagatacttcatctgagtcttgacacctcaggactaacacagaacaagttgtccatctgagctcagattctgacactcatgttacctgagccgtggtcttctcaatagataatcttgcctttttgactgtacacctgggactgaatgtaatgaagggtcttaagttttcttgggctttggtttctctattaaaccctagtagccataaattgggagtatccgattagtcatagcttttctaacttcacatctatctggttttcttattataactgtatttgtgcctccattattttcctgagttctagttttcaaaatatgatgtactatttaccataaaaatatatcacttggtttattgcatatgaaagctgtatttttctttcatattttcctttttgaatttctagagaacattctatgccatagtatggggagtagtgatggtagtgaggtaggaggcaggtattttcctctaagatgttaaggatagatttagtaccattatgatctcttctttgacatgtgggttatttagaagtgtctttataaattttaaaaaaaagtattgtgataagaaattaccttattttaaattgatttcttatttaatttaatttcctcgaagtcagagactggtctgtatgggaaggattttttaaaaaaattatgcagacttgcattacagcctagtacatggtcagttttgggagtaaatattctatatgtgcttgaaaataatgtaattctccagttggatatagattttttttgtattcctattaaatcaagctcattttgttgttcaacttgtctatatatttactagtttgtatctgcttgtaccattcataattgcaacaacaaagaagtatatgttaacctctcattttgatggttgatttttcaatttctctcttttgttcctttgtatatttagtgatgttttattagtgggtgcatatttattatctctatgtagtgatcttatctaacctttataaagcttttattgtcttttttacttttagatattaatatagctacctcagctttcttttggctagcatttacctggtatatcttttcctatctttttactttcaattttcccttcaatttatgttttagatgtgtctctcataaatggcacataactggattttttccttttatccagtctgttaattcctgtatttcaaagggtgaattttgctcatatatgagtttcatattcattgatatacttgaacttgtttttaccattttaccttttgttttctctttgtctcagttttttctgcacttacctttgtcttcttgccttttaatttttgttcttaatttgttttctgctcctcattactgattctgcaagatcccattgcaaacaagctggctgttaacagggttagtgttggaaacaacagcaacctatggtggaaggtggggcttggggtgggatatggcttttctgaaaggagtcagattggcaagtgatggggaagaggaggcagggagctgatagagtccatgtctgatggtcttacaaaaacctttttacaagtatgagacaagcatgtctgatgggactggagggaagggaagtgggagtgtgagatgaatgaaggcttgaatagaacccaaagggactaggtaaaggaattgaacaagcataagtaacagaatttatgggtgacaatgagggttcagctgaggttgtagaccaggaattatgtagaacctgggtataggagcagacaaggcaggctagagcattagcacaggtttgggattttcatgggcagttgtggcagagggatgaaggtatatggatatggaaggtactggtgagagtggttcaaatgttgagccatctggagtccaggatgggtatggggggaagatagatcagcagaaggcaagtggaccaagagacaatgtggggctcaagagactgtggtcttgataaagttgaagaacagatagagcaggagtgagctgtggttggaaagtgggaattcttgaatttaagatttcagagggggcagttctggttggtcaggtccataaatgaaaaagaaagggcagatgtacaatattggtagttccattttcttaagatactatctttatttcctcaaggatcttcttacttccctggattttgatattacttggtctcattattatgccaacgtgcctttctcatcacaatattctgctgcctctccacaagcaccagtttttaaatctggtatggttctcatttctagtgtgcctgtgctatccttgctttttagctgacaggtaactgataatacctcttttatccaggagccactgatttttttgcgcagtgtttcagccgtaatcacacatatgggaattcatttccacaatgcttttgatttgtctgtttagtactttatagttgctttggttataattctgcctagactgagcctgtagagcaccaactctggtgtcagattgcctgggcttgaatccctgcaatttcacttacttgctctttattcttgggcaagttagcctaacctctcctgaatcctaatctatacaatgggggtaataatagtcactcattcttggtattgtggcaaggattaaattagttaatatatgttaggtacttgtttggcgtatagtcaattctcaataaaagatactgttggggtgacaatgacagtgattgcaatattggcagcatatgcaaaattgcataccagatattgcattaagtgctagggcagatacagaggagaagattgaaaaagtccttgttttcatggagggtatatattctccttggggataagaactaagaacacttcctcaagactgtctaagaaagggtgtgtgcaagaggcttaacatcttatagttcaataaagaccaggaaatatacaagttgaggaaatattgaggtttcaggaacctgtatagctttgccgtgttgtttatgttctccactgttttgtagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcagatacattttttcttcctgaggtccagccctgtgtctccaactatttcctgggcccagttacctggatatcaagtatgcaacactaacttaatagggttaaaacaaaactttttgccttacttccaaacctgtttctttccttacatcttctattgctatgagggctgtcactagccagtcagttgtttaatcttgactgtgaactaggcatctttgacttcaccttcttcatcctctctgctcagtcagtctccctattctgtcaattctacttctcaaacctattctgttttttcttgctgcctggctcaggcctttatcattttagaagattcagcaagtatttgtactccaaacattgtgattggccctttaacacacattatttaattttttaaacaacgtttgaggtgggtcgttttgtagatgagaaaccaaagagtcagaaataaaatgacttctgctgggcacggtggctctgtctatagttccagctacttgggaggctgaggcaggaagatcacttgagcccaggaatttgagtccaggctgggcaacatagtgaaactctgtctctaaaaatgaaaaataaaatgaaatgaaaaataaaatgactggtctaattgtttagaggcacagttagtaaatctagattgtcttttgctgcagtattgtaataatatctctgcctcatttgtattgttttcttttttgagatataaatggaagatatatgtaaaaacaaattagaactatgtgaagtaaaaagtgaaagttgccccttcccaattctactccccaagggaaaccaatgatagtggcttttgttctagacctttctctttgcatatacaaatatttagataaattctttataaaagatcattttttattgtcctacaactactttttcactcatggccatatttttatgtcagtacgtgtgtatctaccacatttttaatggcgacataatgttccattatggggacatattattttgtttaatgattcctatgttaaataactgtttctgttcttacaaataatgttgcagtaatagtcttgtgcatatactcttgcttgtgcatttgtatgaatatttctattaggtaaattcttagaagtcatattgcttggttaagtatatgcctattttaaatgtatgtactaccaaattgtcctctgatttgtcctctaaatcagtctttcatattataactagagcgatatagctataatatgtctttgtaaagtgaatttcatcatgtgatttcccagcatcaaaaagcaacatcagagatgtttggtggatttctattgtctatgcagtaaattttaaaattaaaaaaaattttttccagacaggatcttgctttgttgcccaggctagagtgggccacatgtgatggcgtgatctcagctcactgtagcctcaacctcacaggctcaaacaatcctcccacttcagcctcccgagtagctgggaatgcagccgtgtaccatcatggctagctaagttttgatttttctttttgtagagactgagtcgccctgtgttgcccaggctggtcttgaactcctaggctcaagagatcctcctgcctcagcctcccaaagtgctgggattacaggtgagagcctccatgctgagccaaaattcttaaaattttaaaaaagtttttaagagttatgtaatctggtcccaaactatctttcctaccattcttccctaccaggaaatttgtcctctgataaggcaaaatccacctcttctgtgaaatttcccatgtatactgctctctttcctctctctatgcaagatagaatgagttgctttcttccctaagttctcatagcacttaatttatagtcccttataatccctctgatagcacttaatgcgttgtactgtatttatgtgtgtctgtctcccctgctactctgtgattttcataagggtaggaactgtgccttactcatctttgtatccccagcactttacacaatgcctgtcagcgtagtgctcaacaagtgttcatgaatttgggaaagatatcctggaggtagtgctagagtgctagtatgataagaactttgagagatagagtagggggtggaagttttgaagtatagcagaaagctgactgactcctgggagaatggaagctggttaggaatagacaactgggcttaaactggcaggagccttcatgtgcttttctccttcactgcagagaccagctgcctggttatttgggttaataggcttgagatttgagaacatttaaagtattaaaaattggatgattgaggactcacttggtggagggggagattgactcagctgttctatgttctttccagactaagatgcatatactgaataaccaatccttttcccagagtcacgaataactttttctttctgaaaaatcaaggactcttcattttcagggcatgtttcggatgggagtaggaagactaaataggtcagatacttctactttgtctctttagcttggctcaaggggaaaggaacctattgaaagggtttagggctgtgggcctattcttgagtaaatcatctgtgtgaaattagttcttttgtcatttcaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggtaagagttccccaaaacgcatggggtcccaggcctttgaccaatgatgtctgggcttttccttatgtctcccacctgactttcataggaatttgtatatgtgatgtttaccactacttattgggtcacgctgggctctgagtttgttgcttccacagaaccaaatagtcttactgtctttacctctcaacccctctccatccaatctatgcatatcctgaatccacttacgcttctgttttgggtcttggcaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatgtgagtgtcacctatggctgagtagagagggggcgaggccttggccgtggtgagaatttctttcctcagcctttattagacaagaaccattctttatccatctgtcattttcttttatttcttcccagagagttgaagaaagcaactggggactggttttatgaccagaaagtgaatcgctttgcttaccgcacaggtagtgagataatcaggatgtccctgcgccacaaacctgcaggtactggacctgtctagagatggttcttggtatggaatcctagtgtattctgactggtagcatcttaactccatgggctcagccagttagtggagaatagaagattgtattgtcatcccttctgcaagcatggtgtatttcaggggatttgctatgagggttgtttcctttttcccctactcataaccaccaccctggcatacttttctttgtcttgaagtgagtaaaagagagacagtgggacagtccctccttcatcagacacagatgggtgacatctggccaggaagaaagatcattcaggagcggcagaaggagcccaggtaagaatcaagtaattgtttaaagaaatgcttacaatatccctttaattcttttactattctttttacttcttctgtttataaaataatagatgttcattataggaaaacttgaaaagtacagaaaatagtaaaggagggaaaaaatcattcctaatcccactactcatatgtagacattaacattttggtatatttacttagttctttattttttatagtttgcattcgctttctcaggttgaatagtttgttctttatacgaacaatttgaagacaaataaaaataacacatgctcattattaagcaacaaatcacccacattcctactaccccagttttcacattatgtgaaaattatttcgtatatcttctatgtatatacataacgggttgactggatggataaactgaaaaatctttttaatattggatcatagtataataaattaaaatcatcctatttaattttacttgaatttaacagaataaaacactgaaataaaatgaaagaatagctaatcttcagacaaatgtttttttaaagtaaaagatattagttgttaacattcctctaagcttaagaaaaaatattatgaaagccattgagcagttggtcacttttttagtggagtttttttggtaacagccttattgagatatatataattcacatactatacaatttgtccatttttggtgtacaatgcaatagtttttagtatattcactgagttttgcaaccatcccttgaatcaattttagaaaattttcatcacctcaaaaagaaaccctttacccttttagctgtcaccctccctgatccctaaacaatcactcatctactttctgtctctctgtatttgcctatcctgggtatttcatgtaaattgaatcatacaatatgtggtcctttttgacttgcctctttcacttaacattaacgttttcaaggttcatccatgttatagcatgtatcagaacttcattcctttttatagccaaataataccccatgatatgtatttatcacattttatctgttcatctgttgaagaacatttgggttgtttctactttttggttattaagagtaatgctgggccaggcgcagtggctcacgcctgtaatcccagcactttgggaggctgaggcgggtggatcatgaagtcaggagatcgagaccatcctagccaacatggtgaaaccccatctctaccaaaaaaaaaaaaaaaaaaaattagccaggtgtggtggcacgcacctgtagtcccagctactcgggaggctgaggcaggggaatcacttgaacctgggaggcagaggttgtagagagccgagatcgcgccattgcactccagcctggcaacagagtgagactccgtttcaaaaaaaaaaaaaaaaaaaaaaaaagagtaatgctgctatgaacattcattaagagttttgtgtggatgtatgttttcttttctttttttttcttttcttttcttttttcttttcttttctttttcttttcttttcttttgagacggagtttcgctcttgttgcccaggctggagtgcagtggcgccatctcggctcactgcaaccttcacctcccaggttcaagcgattttcctgcctcagcttcttgagtagctgggattacaggcacgcgtcactaagcccagctaattttcatatttttagtagagacggggtttcaccatgttggccagactggtcttgaactcctgacttcaagtgatccacctgccttggtctcccaaaatgttgggattacaggtgtgagtcaccatgcctggcctgttttcatttttctaaggtggatactttggagttagccgtcattttaaaaatctgcctgtttcaatatttaacattatcagtgggcgctttgctgtgaaagaggaagcagttagctttcttacacttcccccggttattttcttctatccccactatttgttactcaaattatttttcctttgtcagggtttataatatttacattctcttatataaccataaaccatctgtttgttttatctgtttgtttccttttagttttatacttaaaaggattgtatgcttacaaccaggccttataccacaacttctctatttctgatttatttcttggttttctggatttcatcattgaggaggtccttcaagaagagcttgcaggtgctatatttattgtattcttacacgttaagaatgtctgccagctgcctttatacttgaatggtatcttggctggatattatattcttgggccacattttctttccctcagaatgttgtagacattgttccattgtcttcttccattgaatgtaactgtgaagaagtctgaggacatcttggcccttgtctttctttcttatggatgagagagagagagaaagagaaagagaaagggagagagattggacttgcctgaaaattttcttttctttttcttgaagtttagtaatttaagggctgggcacagtggctcactcctgtaatcccagcactttgggaggccaaggtgggcggatcacaaggtcaggagatcgagaccatcccggctaacacggtgaaaccccgtctctaataaaaatacaaaaaaattagccgggcgtggtggcgggtgcctgtagtcccagctgctggggagactgaggcaggagaatggcgtgaacccgcgaggcggagcttgcactgagccaagattgctccactgcactccagcctgggcaacagagcaagactccatctcaaaaaataaaaaataaaaaaaaagtttagtaatttaacaaggttgtaactcaatggtgatcattctgtatcatttttccctatatgtgatatatccttgatgagttctttcttcattgctggaaaatttttctgtatcatgtctcagaactctttttctttctgttttattatttaagttctccacctcagagatactggattttcttatcctctatttttgtcattttcttttactagcgaatggaataggaaaaatggtgaaagcaattaactgtgattagcccaacccattcctccatgctattaatttggttttcagtttatttccctcccctaccccttttcccctcccttccttactttttgctgcttctaatttaattatttgagtaaattatcttatttaggttttgatttgttctttgctctaatcttctttctctcattttgttttatcatcttgtatttgaattcttgcactttattgaatttatattattagttcccctgtagtgtaaagcactcacatgaaacctacttgttttcctagggttaaattcttctccagactcggttcttcatccatcttgcaaattgttttcatttctctccacttcatggctatttatatatctgccagactattatttcattttactgaactttaatatgggaagttttgtctgtatcttttgtttcctctgatatagcatatgtgagttcttctcaccttaacttgaaacaatttatcttttccccattcccagctgtactttagtttaaggactgaatattgctttttatatttctttccttgtaacctgaaggggtaggtgcagaaggcaacttggagtcctgagttttggtctcatgaaattctcttaaatgtcctggttcagggcttacctgtcccagatctgggttaatcccctagctcataccagtgccctgggagatgacattttgcatcagtcttgtctgtctctgttgaggttctacagtggtacctggggctataaatcttgaggacttctgtttttcttgactactcactcacttaatctgcaaattgctacattggaaaggattagttaaggagctttgctgaattaaatcttctgttttcttaggtgcgatttttgaaatctgtgacttgaggctttatttttgactcatttggttgtggcggtgaatttttagcttttgtatggtgtgtgtgtggtttttttttcccctaactttcactcacccaaagggaaatgactttatcatgtttcatatgattgttgaaaaacagcatagaaatgtataaagtaagtcctccagtaacctcactgcttcttccccagataattatcgttaatagttgtgaatagttttggcatatggactaccaagctgtctaaatatacatatatgggttgggttcctaagtttttaatttctttttctttaaaggatgatactataaacatgttaagtgaaaaaaagtgaaagaaaaagaactttaaaaactcaataatacagacaatcccatagaaaatgcacaaaaaatttgaacagacatttcaccaaagacaatatagagatgtcagataagcacatgaaaaggtgctcaacatctttagtcattaaataaatttgacctaaaaatcacaataagatactactacatacccattagaatgactaaaattaaaaagactgaccatgccaattgttggtgaggatgtaaaacaactggatttaaaaaaaattttcttttctacatttcctccttgctattataaacaactagcattcttatacactgctggtgggaatgtacaatggcatagctactttgaaaagcagtttagcagtattttaaaaagttcattgtgcacctaccttgtgattaagtcatttcattcctgggtacttactcaagagaagggaaaacgtatgtttgtacaaagacttctacgtgaatgttcatagcagctttatttgtaatagcccaaccctggaaataacccaaatgctcatcagcaggtgaatggataaactgatttgtttatacggtggaatactactcagcaatggaaagaaatgaactattgatacacgcaataacatgaatgaatctcaaaataatcatgctgagtgaaagaagccaagcagtaaagagtacatactgtatggttctgtttgtataaaaactagaaaatacaaactagaaagcagtgacagaaagcagatcaacacttacaggaagggcaggagggattagaatggggcaggaggaaacctttgggagtgaaagatatgttcattaacttaattgtggtgatagtttcgcagatgtctacatttgtcaaaatgtcacgttgcacacttgaacatgtgcagcttatttatgtcagttattactcaaagcgtaaaagaaaaaaattgtagaaggatataacatgaacatctttctgtgtcagcaccaaggatctgtttcattcttttgacatctgtatgatgtttcattgtatatatggactgtgatttttatctacacagccttgggtgggtgactcatccgttccaggtgatgaggcccccttttttctttgtggattaaggataagaatggcttttatttgctgaacctgattaacacatctgacatcatcagtcagaatgtaatttctgaaacctattgcttctggttgtctgtgatctcttgtctcattggacccagaagactcttatttatcctaaacatgaaaacagattaagtgaccataaatgatctttcccatgaaattatggagcctcagagataatttaattcaaccaccctatttttgcagaaaagaaagcaggataagtgatttacctgagatcatacagatagttagagcccagggctcccatctcttagtctattttttactgcacagatgtcaaataattgcttttctgcccttgggttgtttgtattagctgtggattggtatgtattaatctttaggaaaaaaaggaaaaaccactctccatggaccattgttaaaactacctctctggaggaatggttctgcttgggtttttttggcgggggtgggggtggggacaaaaggggaaaaaggacaattctaaagtaaaaaatgaaatcaagcccccctgctatgtcttgtgctatacaagtaatacatctttcaaggaatgactgacatttcacctcttgtaagtactaggatttcagccctgctgtctgttttcacagaactgtcaaacatcatgtgacaacttggagagtttattctttactggctaagacattatagattttggttacctcattctttgtgcatctattagtttgtttgtttgacaaatatctatgaatgcctactatgtgccaggcattgttttagaccctgagatacactggtgaatacaaggcctcttgtttgtggggcttagatttccggggtgggagataaaaagatagtcaagtaaatgtatggtatatcagatgttgacaggtgctgtggagaaaatgaagtagaccaaaggtatagggagtgccaggaatgaatgtgtgtacatatactgtttaggatagccagggcaagtcttaacaacagggtaacgtttgagcaaagatatgaaaaaaatgagggagcaaacccttagggtatctgggggaagagcatgtagatagagaaagaaggaggtataaagaccctagggtgagattttgtttggcacttttgagtaatctgaaactgagtgagcaagggaggctgaggaaggagttgaggacagagatgggatgagaagcagatcatgttaagactttggtggcacttgtaagcattctgtcttttactccaagtaagaaggatggctctgaggggcacagccttattttgtcttctttttaaaaatggaggtaaagttgacataacataaaatcattttaatcaattttaaagtataaagttctgtgattgttagtactttcagaatgttgtgaaattagatcaccactatctaatttcagaacattttcaccatcccaaatagaaacccgatagccattaagtagccacctccatttaccccagcccctaatatgctttctgtcttgatggatttgcctaatctagacatttcatataaatgcagtcatgcaatatgtggccttttgtgtttggcttatttcaattagcataatgatttcaaagttcatccatgttgcagcatgtatcagaatttcattgtcttttattgatgaataatccattatatgaatataccacatttcatttgtctaatcatgcattgatggacatttaggatgttttcatcttttggctattaggaataatgctgctatgaacattcatgtaacatttttgtgtggacatatattgtttagttctgttgggtaggtacccaggaatggaattgctgggtcatatgatagttctatccctgatttacattttaaaagctcattttggctgttgagggaaagtcaaagccaagggaagaagcaggattagttaggaggctactgcaaccatccaagagctacatgatggtggtttggaccagagtaatggcagtggaggcagtgagaacgtatcagagtctaggtatacattgaagaggatttgctgacagatttgatttgtattgtgagaaaaagaggagtaaccgatgattcttagcgtttttgacttgagaaatgaaagggaattgccatttgatgagacagagcgaagagcagttttgggggaagattagggctttggttttgggcttgctgtgtttgagacatccacgtggagacattgaggaggccattggaaaaacaagtctggagtttgagtaagagataaatttgaggccgggcatgatggctcacgcctgtaatcccaacactttgggaggctgaggcggatggatcacctgaggtcaggagctcaagaccagcctggccaacatggtgaaaacctgtctctactaaaaataaaaaaattagccagccatggtggcacaaacctgtaatcccagctactcaagaggctgaggcaggagatcgcttgaacccaggaggtggaggttgtagtgagccgagattgtgccactgcactccagcctgggtgacagagactccatctcaaaaaacataaaaaataaaaataaatatatttgagttattagtttattgaggatatttaaagccatgagactagatgagatcatttagggataattctagatagagaggaggagcagcccaaggaagaagtttggacataatctaaatattagaggtctacgggaggaggaaggactagcaaaggagactgagaagcagcagccagtgaggttggaggaggaaaccaggagagtgtggtgtccggggagccaagggaagttatttgagatatttgaggaagaatcgatgttttttcccccttttcctgctgctctcactaattctttgaggtaaggggccgaggaaccgtatccttcccttgaaagatgagaactggtattttgaatgcccagagtcatccttcattaaggcgattaagctaaaaaaaagaattctggtcacctgaatactgtcttctagacatactgcttatttatggatatatctcagtcccactgagggcatttattcaataattcagtcaataaaaatacttgagtgcatactctatgctagtctctcttcaaggcactgagaacacatcagtaaataagatacgtggtcactgatcttatggaactttgtcgaatggaggagaaagacattaaataatttgtttaaattattgaaccaaataaataatttgtttaaaatacataaatagttacatatgtggtgactgttactaggaaatcaggatgctatgggagcacagaggaaggttactaatcgagacttagggtgggggcatggccagagagatctggaggaattgacatataaggagagacctgaagcaggagtagattgaggcaggtgaagaaaagtggccattgtgaaaagaatatcttaggcagataaaagagggaagatggagagcttcaggatattcagagaaacaaaataactttgtctttctaaaatataaagcttgaaggaggagtagggggtgaaaaatgagactggagagggtgagcaggggccaaatcatgaggatttcttgccatgctaaggagtttcagctaaatcccaacagcaatggggaaccactgaagagttttaaaagtatactgagggccgggtgtggtggcttacgcctgtaatcccagcactttgggaggccgaggcaggcggatcacgaggtcaggagatcgagaccatcctggctaacacattgaaaccccatctctactaaaaatacaaagaaattagccgggcatggtggcacgcacctgtagtcccagctactcgggaggctgaggcaggagaatggcgtgaacccaggaggcggagcttgcagtgagccaagatcgcgccactgcactccaacctgggagacagagtgagactccgtctcaaaaaaaaaaagtatactcagctgggcaccatggtacatgcctgtactcagctggtacaccatggtacagttactcagaaggctgaggcagcagggttgcttgagcctaggagttagagactgttgtgcactatgatggcacctgtgaatagccacagtactccagcctgggcaacattgcgagaccttatttcttaattaattaatttattatatgtttaaagtatactcatatttattttagaaagatcactcaggctacgattgtgaatggattggaaagaggcctgactagaggcaggagaacctgcttcctttcaatattggctcttggtttttattctagtgtgctatttgaagtgccaaagctgaaaagtggaaagagtgcattggaagctgagagtgagagtctggatagcttcacagctgactcggatagcacctccaggtggggttccccccatttccctcatctcctctcaacccaagttgtgattttgttctgcagcatcagtgttcctgacttctgtcctcaggaagttgaacgaagtattttctctgtcctcaacagaagtcttttcagtagcacgtctactgatttggctctgagcacagcttcctggaacacattgacatctctagtcaattcccccagtatcttggagtattcttcttagcccagtagcaactgatgctgctgtcccttaagaatgagggtgtgagtgtttgtgtttgtgcaaagttgcctatctgatcttctgcattccttccaggtaaatcacatgcgaagtgtaccttctgaatttggttattacgatgacccaagccattggctctccttccatagagctttgatccctgggtagaaggggaagggtaggaggtgacttagttataatttctgaatctacctccaggagagactctctggataaatctggcctctttccagaatggaagaagatgtctgctcccaaatctcaagtagaaaaggtaagcttcaggttattgagccaccttcctcccctcccttccttccctttctcctttacctcctgtctccctccgtctttccctccctccctccccctcactcttctcttcctctttcttccctccctccctccattctcttaggcagaatttaaatcaggaatttcaactaaacaaatttcagttcaaattcacttgggagcattttctgaagttttgtttgaaatgtgtgagaaaataggttttgtactatttctaggcatttaatctttcctttaagtttgtcatagtttagcgaaaatctgagccttattcttcttaagactgtccttccttactcactccttctacctatccatctgttcttttccattttcttgcccttgttccttcctaggaaactcagcctggaggtcaaaatgtggtatttgtggatgagggtgagatgatatttaagaagaacaccagaaaaatcctcaggccttcaggtaactggtttcccttactggtctttcaggactgaagttctgagtacccttgatgggctcttggtatggagaagaataggtctctttgatttggcttttttggtcttcccctcagagtacactaaatctgtgatagatcttcgcccagaagatgtggtacatgaaagtggctccttgggagacagaagcaaatccgtcccaggcctcaatgtggatatggtaggtgcccttatattttacttggtcactatatgaaattttacttatctggagttggctttagtacctgatattctcagtcaacctatttaattctttaagaaaaggcaacatgaaacttgatacccccaagtttctaaagtaaatctggttcctgatttgcttaaaggaaaggactgtctttgctatctcttttttttttttttttttttttttgagacggagtttcgctcttgtttctcaggctggagtgcaatggcacgatctcggctcactgcaacctccgcctcctgggttcaagcagttctcctgcctcagcctcctgagtagctgggattacaggtgtgcgccaccatgcctgggtaattttttatatttttagtagatatggggtttcaccatgttggccaggctggtcgcaaactcctgacctcaggtgatccacctgcctcggcctcccaatttttttttttttttttaagagacagcatctcactctgtttcccagactggagtgtagtggtacaattatagctcagtgccaccttgaactcctgagctcaagctgtcctcccacctcagcctcctgagtagctgggactataggcatgaaccatcatacccagctaattttttttttttttttgagagatgggagtctcactgtatttcccagcctggtcttgaactcctaggctcaagtgatccgcccgcctctgcctcccaaagtgctggaattacaggcatgagccatcacgcctgaccatctcttttattttctaataaattgctggatatatggctggggctcaaataaatacttcttttgattaaaatgtaaacagggttggggaaagtcaaatggaaaagagttatagcttctatgaaaaacattaaatattcttatcttattcttttgagatatgagaaggatggttggaatagagctgggaaccctgaaatgggaagacatgtaaaaagaaggatatgaggccaggcatggtggctcatgcctgtaatctcagcactttgggaggccgaggcaggcggatcacctgagatcaggagtttgagaccagcctggccatcatggagaaaccctgtctctactaaaaatacaaaaattagccaggtgtggtggcgggtgcctgtaatcccagctactctggaggctgaagcaggagaattgcttgaacccaggaggcggaggttgcggtgagctgagattgcgccattgccctccagcctgggcaacaagagtgagactccgtctcaaaaaaaaaaaaaaaaaagaagtatgtgtgcgtacacatacacatggcaacttggagctttaaaggaaagatattagtctttgaagctaaagaaaagtctttcttttattaactctgaatttatatttattgttccaggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaaaagaaagaaagaaattttgtattaagcagcacagatatgcatccatgtatttatatgtatttttttctttttttacacaaatgggttcacatggacctcattgtacacatttttttttttcatttatcatgggcatccttttgtgccatcacttacagatctatctcattttaattgctgctgcatagtattttttcatgtgcctgtattataatttatttaccattcccccactaataggcctttaagttgtttgaattcttttttgctcttaaaactatgctgtaatatatcttggtcttcttttgtgaatgtaactgtcagagaagttcctgttggtggaattgctgagtgaaaggaaatataaatccaatattttgatagctgttgcccttgcaaaaaaaaatagtgacaacattaaatttgtccctttaaatactaataaaaacaggaatttgttcaacagcacagtaggatgactatagtcaacaaaaatatttgtatttcaaaatagctagaagatttgaaatgtttccagtgcaaaaaaatgataaatgttcaaaatgatggatgtaacaaaatatcacatgtaccccataaatatatacaaatattatatgtcaataaaaagacaggaaagaaattattaccaaagtataacatattattacaaatttagaattttttaaccatttggcacccaagtcattctctacggtcaatataattatattggaaatgtcactgtaaaccatcatgaactactgccaataaaacttttatataaagagaagaaaccacattaacatggaggtctttgctctttgtaaatatttggagccagaataagaatgtgctactaaaacaaatatgccagtttctagctaatgctaaactccaatttttaagagtccactgaagttcacagaacttttctaaaaaataattttctagaaattaataaattgtgtagacattttataaacaacagaaagaccattcccatattatatatcgattttaacttctacatttgttgtttctggttttgtttttgttttttgttttttccctagcaatccatttgctcctattcagttttcccttgcctgcatctacctcccgattcttttgtctctctcacatatattaaactgtgtgttctgggtatgtggtatgttgatccaaacttatggggattatgccttcctagcattggtaaggacctaagttagaggaaccccaattaacacaggcaaggccaagtgcagtggctcctgcttgtaatcccagcactttgggaggctgaggtgggtggatcgcttcagctcaggagttctggaccagcctgggcaacatggcaaaaccccacctctacaaaaattagctgggtgtggtggtgtgcgcctgtagtcccagctactcgggaggctgacgctggagaatcacttgagcttgggaggcagaggttgctgtgagccgagattgcgccattgcattctagcctgcctgggctctgggaatgaaaccctgtctcaaaaaaaaaaaaaaaaaaaaaaaaaatacaggcaggtgaaagggcacctctagtctgcaccagctcatgctctggatactaaagcacaaggaacaaagtcatgccgagagagccaatcgagtgaagcagttctgccaatcaaagccaaagacaataggccacctgctgctcatctcagacattcattcgttcactcttaccttcattcagtaaatatttgtggagcacctactatgtgccagatactttgctaagtgttgggcatactaggatgaacaaaaataggcttgatttctgtctcttggcacttcggctgcagtgttagagacagacattgatcaaagataacttaaatgcaaaatttataattgtggcaaatccaaattcgtgtaacagagtttcacctagccctcaaatctttgcaagccctccttttttctttttttggggggagggacagggtctggctctgtcgcccaggctggagtgcggtggtgcgatcttggctcactgcaacctccgcctcctgggttcaagtgattctcatgcctcagcctcccaagtagctgggattataggcccacaccaccccgtcggctgatttctgtgttttttgttgagacaaggttttgctgtgttgtccagactggtctcgaactcctggactcaagcatttgcccacctcagcctcccaaaatgctgggattacaaatgtgagccactgcacctgactgaaagccctctttttttttttcccctgcaagccttctttttaaaaataccttgtaaaaatactttgtatttttaaaaaccatacaaatgatatatactattctcattaaaaggacactaaaagttaatatggagtaaaaaagggaaagttgtctttcatttccctattctgttgccctccctagaggaaacgaggataagtttgttcgtatcctgggtttttctatgcagtgtagtataatgtttaaaagcacggactctggaaccagtctgtctgaatttgaatcctagctctgccaattactaactgtgtgaccttgggcaagttacttagcttctctgttcctctcttccatcagttgtaaaatggagttaatagtacctgtctcatagagacagtcatcaaacaaaatgatacacctaaagtacttataacagtgcctagtacatagtaagggctaacataagtgataatggcaatcgttatttacatacatttatattcacatgtacaactatgaatatattttaatataagtggaacatttttctgcatcttgctttgttgacttaaccctatgtcttggatatctttccatgtcagcatgtacagattcactgaattcttttttgatgactgcatgccatatgccataccaggacactacaattattcatttaactctttctatagtgattgacatttaggtcgtttccactttttggctattactaacaatgctggtagcaagattctctgtcatgctgtcagtccttcgtgagtttgtatggcaaccttgcttgaagatctttgagagtatttggaatctagtaactatgcccccaaagtggcataatagtgggtattgcagaagactctttgttggttctgccctatttccttctaaagaaactgccatagaaacctgtggctgccatggcctagggacggtggattatattcatatgaagaaggatcctcttttgccctgatgctgttcttggggggtaattttagaatttttttcagagagaagtcccaacaattcttgagaagcccagcttgacctgttgggtttccctgtgtttcagatcagtgctgagtccccgactggcttgccatcacacaaaggcgagttggtggtttcattgaaatacatcccagcctccaaaacccctgttggaggtgaccggaaaaagagtgagttttctttggggtcctggatgtagcttagtcttctgcataggatctgtgcaaggccggtgctggctactggttagcactgttggagagaccaaattgggatgctccctggatctgctagggagattcctttactaaggaagcctctctgcgttttttcaaacagaagggaatgccttagggttggcattcttttctttttttaggctattaaatggacttggtcttggtccagctgtggcaagctactaagagggcagaagagaacagaaactttggggctgagaagggtggctgggagaggtggtaaagtatgaaggacaggaagttgaaagctggggaagagtaattcaacatgccagctgctgtgttagtgactacggttgtgtagatgagtaaaacatatttgctttcccttgaggagcttaagtttttgcaagaaagacagtcatgtgctaaaaggacacagatataggagtggtgaattatgtctggttacatttgggagagctttgaagaagtaacattaaaactggatcttaaaactttaccagacagaaaaggagcaggatgaggagagaagagcattttcagaagaggggataacatgcgcaaaggttttaaaaaggcatggtaatgtggggttgtatgtgagtgtgtcccttattttagtgggactggagttctggtacactagatgtaggtgtggggctggagttggacatgaggtgggagcctgactgaagagggccttgaacttaatgataaagagtttcacttgatcccttggcaatgtgtggcctacgttctttgaaaaaatatacctttggcagagtcacatctagaaggtttgggggaatcaatgaaatccccaatgagggtatgtagcatgactagagaagagaggcaagtatagaaccagagagatcagcaacattttaaaggatgaagagagaaagaaacaccagtgaagtaaaaggttatcaggagagagcttcaagaagaaggggcggaggttatcaacagtattgaaatactacagggaggtcagaccagatgaggtctgagaagacatggccaattggcattagattgcattttcagtggatcagtgaaagcagaaaccagatttcactagaaactaggctgagtgaatgggcaaagaagtagaggtggtaagtgtggactttttttcctcaggataattgatggtgaaagaaagtagagacatggagaatagcttgaagaagagataaggttaaagggagcttttcttttagaagtactttttcaaagagatgagattagtatatatttagactgaggggaagggacaagtggagaaagagatatttaaattgggaggtgaggattgaaattgatgatgtctgaagagtcctgtgaagtaggggtggaatcgagaactcagatggaggagttccctcttttttaaatcattgaacaaatatcaggcaactttatgtctctaagcctcaattttctcatgtacaaaatgaggacaaaaatagtgtgactctcctagggttgttttgagaattaaatgcttaacatggtatctggcacatagccagttttcaataggcatttattaatattgtggttgttattaatacagcacctattgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaaggggtgagtccctagaccagccccaaattaaccagtttcagaacaagagagctaagagaagaatttaactttctctgtggatattatccagtgtgtcttaccactcccggcaaccaaatttgttcctgaaattaggtaatgacaaaaccttcaccacctttgcactggtctgggctgtagacttgataatccaaagaggagggctgcagacaggttctgacttttgtctgactcatgttcttaattaattctgggtgaaaatctgtgtcttctgactgtctagatttgggaactcagggctttgtttcccacagtttttaagctttccgaaaattacagattacctactgacttaatttatctagaaatcatgtttggctaagtttatagatattactattggttttatttaaagagataaattgtctagtagaaacaaagccaaatatttaaaacccattttcagtggagcacagaatagcctcactaatactattatattcattttctctctaggttaaaggaattgaatcaggtgaatgatctagtagaggtagtgggaactctgcttcagcagattcaaggaggggcgtgtgtagtaggatctggatgtgggttcatcttcttgggctaggcctgtggtaggggaaaggggaatttagagagataactgtccgctttgagtaggctgttgattactccccgccctctgccagatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactggtgagatcccctcccccatcctcacttgtttgaaggcttcttgtctattttactcctattaccattcccgccccccaacacaaagctcctctgtgatgacagttgtcttctttcctttcagttaacattcagccaatacttattgagtgcctactatgtgccaggactaggggaaggctgagctcatgcactgatatgtgcacagataaatgtgaccctgattgccaggaacttcataatcttcccaccaaaaaaatctacaaacctacctatatgtatgtacctatacattccatcttccatgctgttaataatgaaagaagggtcattgctagcaaaagccaagctctctccaagtgctctgggccacctccccctacccttctcgatgacctcacttctataatcgtcatctctcagtttcatcctccctacctaccaggggtgaatacagatatgctctggtatttccaatcttatgaaacaaaaacaaacctttccttgactacacgttccccttctagtttcttagaaagaattgtctccacttctcacctctccttcagctctccttcactgtgatctggcttttgtcccaccactctgctgagcagttgctcttgccaaagtgttgttctcatctcactagaattttcagcactatttaacatgctagatcactccttttcgcttgaaacgctgaacttctattgacactgcattctgattcccttttaagtcactgctcaccccttctcagttttctttgtaggtgctgcattctatacccaaactctaaatgttggtgcttggcagagcttagtctcggatcctcttctttgccctctccctagtctctgcacttgtctattaatatacttatatattaataatcacacagaatatttaacatgaagcatatagactgatgtttttacacatgtaagccaattcatgtcagtcccctgttaaaacccctcagtggctttctgttgtgcttagaaaacaatccaaagttcttaacatgcctacaggcccctgtgtaacctgggtcctctgttcctttctgatccgtcttgtatcactcttccccttgctcactatgcttcaaccaaaatgactttctgctctccaaatataccaagctcattcccacttcagaacctttgcaattattgttttctctgaatggaaagtctggttctttcttatccttcaggtcttggctcaaatgtcaccttctcagagagtcctcagaccactccatctgcacagtagttcctgagtcagtcactatacatcaccctgtttatttacatcataatgttaacctcactgtctgaaatactcttattggtttgcttgtatattttctgtcttccctattcaaatgaaagttgcctgaggacagagactttttctgctttgtttactagtgtctctagagcctagaagagtacctggcacacagtaggcactcaataaatgtttgctgaattaatggatgaatatataagagaatatgaatggggccacatacgatcctcacttctgacctggagtctgcagctagaggagaggtgtttagctttaaaagaaaaaagttggccgggcacggtggctcacacctgtaatcccagcactttgggaggctgaggcaggcagatcacgaggtcaagagatcgagaccatcctagccaacatggtgaaaccccgtctctactaaaaatacaaaaaaattagctgggcgtggtggcgcaggcctgtagtcccaggtactctggaggctgaggcgggagaatcgcttgaacccaggaagcagaagttgcagtgagccaagattgtgccactgcactccagcctggcgacagagcgaggctccgtctcaaattaataataataataaaagaaaaatgtttaagtacagttggcaatagctctggcatgagttgtcaggcactagaactctgtaacagcctcagaataagaagtctctagtgactgtgtgccatttggagtctgatttcatcaacccagagtctcttgacagagtctcaggaatacaggtgagggagcacttcccagactgctgtggccattagcccatcttcgtaggaaactgttatggggtggctaatcttgctgtacaacccatcttccctggtgggctgagagtggggcccctctttagcctcttctggtgtttctcctcagggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgt

SEQ ID NO: 4779 - DNA, 57010 bp, human
cacagcgctcggccgtcgagcggggtcgctaacccgcactctcttcggacctacgacatcgcggcttctctggcgttggccagtcagccacaggtaaaggctggaggctggttggctggagtcctgcctcagtgggctccctctgcgcttggggctggggacctggctgtgtgctgtggagctgctttatattgccgctcttcaagcaggctgtgagagatctggtactggaggagggtccccgagatctcagaaggggcacagaatgcttctgtctcctgtgttggtttgtaatggggcagaaaaaggtgttcctccaacccttaacattgaatgaggtgggatttggggtggtgaaatcatttggttagaattctggtggcttgaaaagtggtgactttctaatcaagcttttcttcccccagtaccctgcttcttcaggattagaggacgtaaaattccagagtactgtgcttggcagggttgaccctagaccttgtatatttgtggcaaaaatgagtcttctgtacatcctggacctcctatatttaactggcttattttctgctctttaagctccccacccccacctctcataaatctattaatattgaggtattaatgacttaagacttttgtcgctgtgggaacaatgtttaatgcagagacgtggccttgatgaagttttctgcgtttttggttgtttggtttttagcaccctagtagaaaagcaccaccaacttggcttgtgaggccctttttgggcagaggatgaacatttctggtaacacaatttcaggtgtctcactcttggtcagagcagtgaaatggagctggaggcctgttctggggtaattgatctgtgagtatatgtagcattctggctctctgagcttgttaggctctggttgttaggctccattgagctggacactgtgataagttctttacataaaaatgcaatcctcacaataactctatacagtaggtgctacagttataaccatattatgatgaaaaagagactgagaagttaagtgccttgccctcaaaatctcggaggcagagcttgtgttcctatcctgtcacaccacctctgttgtcttagatgttgggaacactgaatagctcatggatgaggactaagtgattaaaaaattgtcttccaagcccaagtatatgtttttctccttgcttccaccttagatgcactgccgagactatggactacttaccttactgatgtcttacccacttcatttccaacatgggccagttgccacgttaccactataagtacacatccctgagtgtaattagatgaatgaaatctcccgggttttcagctctgtggtaattgtcctgaagttaggggagggtaaccctggattctagggatgtgtgcctgactcaacttcttcctctcctgctggctaggggagaaatgagggagtggtaagtgatatggatttcctgacagccataccagagagcctgagggtgatcgtgtgctagttttgtcatgggatggatggagtaccatagacaaggataggaagaaaatgtcctccctattcccatctctgggactttgctcaaactgttcctttttttcttcctaaaaagctaactttcctccctcattccccctcccctgacattaattcctatccatccctcaagattgagttctaaagtcacctcctttggaacggccttactgaacacatacttcttcccccaagcagaattgccagttatcctgtgtcctaaagcactttgtttacacctcagtaaagcccttaacactgcttagttgtttttccacctggaaggctgtaagttctctaagggcaaggtctggatctcggagctccctttgtcttaaatataagatgttggcaaatatttgtgccagtaaccggacataccatgccattccttcaaggggctgaggtgtagtgatggtggggttgaggtacagaagacaccttcctgaggcacttgaaataccacagctaggaatttgccctgaccaccctatttaaacgtgtaatcccttccctgaacattccatatgccctttccctaccttattacattgttcttgcttattgtctgccctcccactccctcacccaccataacataaacaccctgtgggcagggattgctgtctgttgtattcaccagtagactcttggacccagaacagtccttggtacatcataggtgcatactaatatttgttaatgaattaatggcattgccattctaggaatttggcactcttggagttaggcactcctggacctgaaactaagcctacccagtttgtcgccctacaggtgtaagtttgccccaggcccaaaactcagctttacttctgctgatttttgctttgagattgcattcctgatgccaactttgacctagttggaagtacttcctctctcttacttttttttttttttgaggcagagtttcgctgtgtcgcccaggctagagtacagtggcgcgatcttggctcactgcaagctctgcctcctgggttcatgccattctcctgcctcagccttctgagtagctggaactacaggcgcccgccaccatgcccggctaactttttgtgtttttagtagagacgggatttcaccgtgttagccaggatggtctcgatcttctgacctcgtgatctgccctcctcggcctcccaaagtgctgggattacaggcgtgagccaccgctcctggcctctctattttttaaaagtatgagtctctgggtggaaatctctaaagtttaaaagtggaaatgtaaaaatgttgtgcttcttgttggtaggaagggggactgcactgggaggaaggggtgtggattgtcagatgtcttgaggcttttcaggcttctcgcaagatcaataagaggctggagaaagttactgtgcaatggggaagtgaacagctcaaaagaataacggatggcacaaattaggcttctggtttcaagttacccatagccttttaggtatgaggtggttattggattatggaactttatggaaaagccgtagctgagtgctatttgtgttgtacttaactagttttctaccaggatgactgtgcagtctggagaaaccactgtgtaacataaaagaaaaaagtgctattctgtttaaaagtgttttgaaatgttcagaaaggaagaggccagaatctcttagaagacagacttggaaggagttgggcccttcaaaaggtggtaaatatgtgattctcatcatttaatatatgttaacttatttgaaactcaaatttgtacaaaaagctgaccagcttctttttctactaaatttgtctccccagcctttgaacattgcagtgacctggggttcagtccctggacttttctccatctaaaatcttcacagaggctctcatccagctgcatggctttgaagaacatctgtctagactgttgtcactcccaaatttatgtttgttacccaggcctttcttctaagctgcagcctcatatatccaatgacctatttgacatctctgcttgcctatcagatagacctctcaaatgtaacgtggccaaaacggcactcccgattgcccttgtattcccaccctcttccctcagcactccctgtctcagtaaaatgtcaccatcatccattcagttgctcaaaccaagaacctaagatcacccttgattcttctttttctatcactgctctccacccaatttaattcatgagggagtcctgctgacctgatcttcagactgtatcatgtgttctgccacacgtctccatctcctctgcctgtcaccctagtccaagccaccacacgtctgccacaaacattcttgcataatgctcaaggatatatatatacacaagtatttttgtgggatagctttctaataggagaattgttaggtcaaaggacatatacattaaacaatttaaataggcatcaccagagtgacatctaagagggtttaccctttcaccattgcgagtggttttcctcctgcccttgctgaggatggatgacgcttttaattttttccaatctgataggtgaaaaatagtatctaactgatttaacttggcatttctctgatcactagtgtggctgagcatcttttcatttgtgctagctatttgtatttttccaagacttgctcctttatatcctttgcacatttatcttttgggttatatatttgatttgtttgtaagaacactatatttattagttatatttacccattgcctattatatagtgcaagtttttttctctctagtctgtcatatgtcataactttgttcatgatgtgtacccctctcgtaatcagataaaacccactataaaacatttaaaaaacacgttcattagatttggcaattaggaggccaatgacaacatcagtgcagcaggaggagagaaggcagatcgtagagggttgggcagtgaggactgagaaggactgataaaaaatatggtagatacacatggacatggagagtgggatgatagacaatggagactcagaagggtgaggggtgggagaagggtagatgatgagaaatttcttaatgggtacaatgtatgttattcaggttatagataccctaaagtctctgacttaaccactgcatatgtaacaaaattgcatgtgtaccccataaatttatataattaaaaacatgtagtatatacattgaagaagcttggctatgatgggaaggagagagtgttccttatagacagtaaggcacaggggataaaaaggctgttttatttaattttgttttactttaaatataagagatagatgagcccatttatgtgcagatggcatacagcttgatgatgcaaggtccccgagaaagtcagagggtgggagtgccagagtgaaagaggagaaaagactagccttagagaaaaagtggtggctcttccattgaaacaagaggattcaccaatcctcttggtaaaaactatggagaaggaagtacctgtggagggacaggattttgagagagcccctccgcccccaacaagagagtgaaaggttcaccagagagtaaagaaggcaagaatggtgaagggttggaatagcatttgagagagacgaaaagaggagttctttaggggcatatcatccaggttatgtatgtgtatttcaaaatatcatgctgtacaccataaatagacacaatttttgtcaagtatacctccataaaactggaaaaaagttttaaaatggcttgggtaacttgaatttgtctctgcctcaagtcgcagaaccctgtatccattctgtctggcagcactcatcagaccaggaacagagtgtggacaatctagtatggggaattttttccgggtggccgtgacagaaatagggagagggctggagattggatggccctggcagaagaatagttgaaatgatggaccactgtggctttcatattcatatctgtgactatctaaacctaacttgaccttgagtaatttttaagaagtagaaaatttccatggcatctacactgcttcttgtttgtagctctatcgattcaggcatcagaataccattagtatcagtgtctttaaactcatcagaaagcgtgatttgatttactgagggcctatgttgtgccatgctctgtgttgatttactgaggatttacgttgcaccaactgagagcctacagtcaggatcctacaatgtagatttatccatctatccatccatcaacccagctagatgcttgaggtatggctgagaagaaggtagacaatggccatttttctcctggaacttatttcggcaggggaagtgtatattaaatattgtatcacataattttttaattacaattgtgataagttctgtgaagttcagttttcttagaaatcagattgtcacattgctttttaacaggccttactaatttacatttgccaacaaaatatgagaatatctcttaaatcctttttaaaaactgaaaattgtctttctgaaattttgctgaattaataagcaaacataaaaaaatctttattgccagtaagagtgaaactttttctttttgatgtgtattggccatgtgatttttcccctttaagaattatctattcacgctctctgtctattggatacttacctcttcttgtttttaatagatctctcattccatgtttgaaaccattagctacacttctctcctttctctcttagccctggtgaccttaaaatattttcccctagtctctacggccattcccttttgatctcctgtgaaatttttttcttacctagaagtgttgctgtgcttagggatgggactacatttttattacttgactcaataaaaggtaacatataaatcttctgttcctgcttatcccactctccagaggtaacaatgttaagattgtatttctttctagacatttttccattcatccatgatccaatctgtctaaaatgtaaacaaataaaaatggaatcataatatatatgatttgcaatttttttaatttaatatgctttcagtgtcagtatatatagaactacagtaccttcttctttttttttttttcttttttcttttttttttttattgatcattcttgggtgtttctcgcagagggggatttggcagggtcacaggacaatagtggagggaaggtcagcagataaacaagtgaacagaggcctctggttttcctaggccagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacatggcaaccatccgatttctcaatcttttccccacctttcccccctttctattccacaaaaccaccattgtcatcatggcccgttctcaatgagctgttgggtacacctcccagacggggtggtggccgggcagaggggctcctcacttcccagtaggggcggccgggcagaggcgcccctcacctcccggatggggcggctggccgggcggggcgctgaccccccccacctccctcctggacggggcggctggccgggcgggggagctgatgacccccccacctccctcccggacggggcggctggccgtgtggggggctgaccccccccacctccctcccggacggggcggctggccgggcagaggggctcctcacttcccagcaggggcggccgggcagaggcgcccctcacctcccggaacgggcggctggctgggcggggggctgaccccccccacctccctcccggacggggcggctggccgggcggggggctgacccccccacctccctccctgacggggcggctggcctggcgggggctgaccccccacctccctcccggacagggtggctggcctggcgggggctgacccccacctccctcccggacggggtggctgccaggcggagacgctcctcacttcccagacggggtggctgccgggcggagggactcctcacttctcagacggtgcggctgccgggcggaggggctcctcacttctcagacggggcggccgggcagagacgctcctcacatcccagacggggcggcagggcagaggcgctccccacatctcagacgatgggcggccgggcagagacgctcctcactgcctagatgggatggcggccgggatgaggcgctcctcacttcctagatgggatggcggccaggcagagacactcctcacttcccagatggggtggcggccgggcagaggctgcaatctcggcactttgggaggccaagggaggcggctgggaggtggaggttgtagtgagccgagatcacgctactgcactccagcctgggcactattgagcactgagtgaacgacactccgtctgcaatcccagcacctcgggaagccaaggctggcggatcactcgtggttaggagctggagaccagcctggccaacacagcgaaatcccatctccaccaaaaaaatacgaaaaccagtcaggcgtggcggcgcgcgcctgcgatcgcaggcactcggcaggctgaggcaggagaatcaggcagggaggttgcagtgagccgagatggcagcagtacagtccagcttcacctctgcatcagagggagaccgtaccttcttctttttaacaaaggcacaatattccctaatatgtgtgtacaataactagtcagtttcctttgatggatgtttatgttctttaatttttttttttttgctgtttcaaatattgagcatcctcagaatatatatttgtgaatttacttgaatatcagcagaataagtttctcaaaatgaaatggctatgttaaaaatatggtcagtggtactaaagatccagagaaatctaggaagaccaagaactgtctattggatttaggaagttcttggtgaccttagagcaatttcagagaactgtgaggcagaaagctaaactatggtgggttgagaaatgattggagagatgaggaagtgaaggcagtgattatgtacaattccttagagaaatctgtctggctttgaagagcagagaaagggtagtagcaaggaaggagttgagattgaggacctgttatttatttatttatttatttatttaggaaggacttgagtttctttaaaggctggtgggaaggagggactaattaatagagcaaaatccttggaaggcaaagtccttatgccagatgggaggggatccagattgaggtagaggattatcctcaataggcatagatgaaagtaggttcatagatttggcggcaggaacttgtctgatggtatttctatttctctatgatataatagttaaggccaacctcttagagcaggggttaagatgggacaaggtttgagttagatatttgtggtatttgaagaaggtttgaaatagttattgtggagaacaggagagcagcctagggaagcatagttgcagtgccaggcagggttaagatgagcttggtgaccaagaattcatatggataataatctaccagagtgtgattttttttttctccagtagatctcaggagtccttgtgcatgcataaagtataacagttgggcttagaagagctatggttttttaaatcagatatttgcagtgaaattatgcattattgaggatattgacaagagtgcagttgaaacaatagaattggctgggtgcggtggctcacaccagtaatcccagcactttgggaggctgaggcgggtggatcacctgaggttaggagctcgagaccagtctggccaacatggtgaaaccccatctctactaaaaatacaaaaattagccgggcatggtggcgcacacctgtaatcccagctacttgggaggctgaggcaggagaatcgcttgaatccaggaggcagtggttgcagtgagccaagatcatgccactgcactccagccagagcaatagagaaaaagtctcagaaaaaaaaaagagaaagaaacaataaaatttaaatgttattgggaaggaagtaaagatgggaaggagctgaggaggtgaaagcagaagggtctatggaagactgcccccatccaagaaatctgagaacaggaatggggctagttggggggctcattggctgaataggctagaagcacagcaggttgtggtcagagagggggtgttgaatcagtgatatcaaaggtggagaagtcctagatgataagctcttgggtgtggctgaatatgatatatggtattcttgatgccagctcattcattcaacaaatatttattttgtgcatattatgatccaggcagtgctctaggcaccaaaggtacagaaatgaacaaaacaaagtcccttctgtcatacagcttacaatctagtgggggagattatttttataaactaaaagaacatccttattgatgtgctgattcctgtatgtgtagctttatttgtaactaatgataataccaggatcaaatatttacatatatgggggctaagaaggtccatctaggcattttgagtatcttgctttatctcaagttatacttactgaattatgaaaactcatacctcttttccccttagaactttttaaggtatttttacttactatgtcagtattgaaaataaacaaatatatacaaatctaatttgaatatttcattggttttaattttttatactgtattttttaaaaatattaggatattgcttcaagctgtagaccagatgttgataatgcatgtactaatcttgctctagggatttgatgtaatgtgtaaagtaattatggttaagcagtttaggagggaaagagggcttgtaataagttaatattttatgtttatttttatattattctccaatttattttattatttatacctaccttttaatgtacatatggtcatgtatatatttattaatattttatttgaaagaaataagcatttatttggcatcttataggcctcaagtaacactttaaaattacctgccacgtatgcaattcaatttaaattcaactacaggttattttttattgttttaaggtttctgtggccatagccagatcacagcatccctaaaattaaaaagaaaccaaatgcatgaaatcacagttatgtgtgagcatgggctggattagtcatgaaccatgatgatttcacatttaaggggactgtgtgggtaatttttaggtgacatggtctgcaagaaataatcagatgccagttagagttcagtttagaaatccccaccatctgtgatcccagcaggagaagagggtcttccctgcgggagtgctgcattatcaaagcttgttgactaaggaaagataatagtgttctgcgtgggaggtgatgaggcttattgaaaaataacaatgtgtcagctctcactggacttaaaaatgttttgtacatataaatgacctagattttaaaacagtccattcttttagttggggattttagattttttaaaaatctaaaaaatggggctgtcaaggaaggggcttttggcagagaagagggtaaactggccatcctgcacccatcagcctatgaggctcttgtgtctggctcatgttagaggaagcttcaaatgtagattttgaaagctggaaagctaaatgggatttgttttaatatatgtattttccctgttgccaagtagggtgtttggacacatggtctttataatattttagagttacttctatgtatcacatttatggaaatctgccttctaggattggtggtgggtttaaggcaccttctagagttgctgaggagcaggggacaaacgtgtagaatcatgaaggaccacatttccacatatccaaaacaaccattctgcaggagaaatgaatatatagtattaagatatctgacttccttctgggacttgttttagagttgtatatattattttaagtgggaatttctacaaaccatttatgaacagaatttgttggtattgaaaggtagctatgtggattccatctggaggaaattgtccccacatatgattctaaaagctaacaaaagaggcattttagttactaccactgccttcttccaccctgctgcccacccccaccccctgccccaccattatgcacctgccatcttttaggatggatgtcctggatgaggggaatgagttattgtcttgcgtataatgttgctttgagctagagttgctctggcgtgttacacatattgcaggaggaggtcaggggtctgggaaagtaagccagactgagggcctctcaaacattgtgtttgttattagctgaagacttttagaaaccccacctcaagttcctgaggttgatgttcccttttccaaaaatcaccatatagagcaatattgccagaatatgaagagacagtataatgtaatgtaacggttaagagcttggactctggaaccagacggcctgggtccaaaaaccagactgtcacagggcatgtgaccttgagcaagttatttgctcaatctgtgcctcactttcctcatttgtaaagtggacataataatttagtacctacctcatagtgtgattgtgaggactaaataaagtgcttagaagagtgcatggtacataataaacattatagaagtgttaactatcattgtcatcatcttcatcagttggtggatatcttaaaaggagtgaaaaccggccaggtgagatggctaatgcctgtaatcccagcacgttgggaggccgagatgggcagatcacgaggtcaggcatttgagaccagcctggccaacatggtgaaaccctgtctctactaaaaatacaaaaattagccgggtgtgatggcacacacctgtaatcccagctactgggaggctgaggcaggagaatcccttgaacccaggaggcggaggttgaggtgagctgagatggcgctgcctaactccagcctgggcaacagagtgagactccatctcacaaaaaaaaaaaaaaaaggagtgaaaagcacaaaatgcctcagcacatgcaaactctacttttgtagaatctattttgaaaaggatcgtagggagccaaaaccttactgcaaaatcagaattttgtaaaattaagagctagttgtaaatttctcattgttagggaaaaatacagctttgctcccatacaacttttgagaatggatttgtgaaggcaggccctaggggattttatgtgaggcatagatgtgctccatggatggacaggtgagggtctagaccccagctgactcctaggaagcctcagttgccctttggttttggagccttgatactgactctaccagtttgtctccactcctatttttcttctttttgatcctatttttaaaatttatgatattttttgatgttttatgaatctttgtaagtcactttaaatcctgtctggaacagtgtataaataaatatcctttaaactgatcatatctaattactaacatttgcttcatatttatgcttgtcagcctccctccatgcagagaggtacggtgaccttccatctaggcaagaatactgattagatttctcaaatttcatagaaagatgtcaaaactgccatatgctcatatattttccaaagcatatggttaataataattaaaactaaacagctaccaatattgggtgcttactctaggccaggcactatgctatgccttttactcatgatgcatgcttgaatcctcaaagccataggcaggagctcttattattaatcctcatttttacaaatggggaaacagactcaaggaggttaaataacttgcccaaagttaattcagggaaaaagcaaagctgtgattttaacccaggcagctcagatccagtgcttttaagcacaattctatgctatactgtccttaattagaaatctagcacatcagaactccaagtcctagtataagaggccgtacttgtgttacagaacattcacaggtcctgcagattttctctccgtgtaatgtctttaatatgcccctttccatctctagtgccactgccctctactcttggctcttgttatctttcccctggatttatgccacagcctcctcaaatccatagtctgcaaaattgtcagtgtgccctaacaagtccttgctttacataaaactcttcaatgatttctgttgtcaaaggctaattagccgtgtttttgcgcgtagcatatggagcacccgccagccacacatgatgtgattccccacctgcctcttccgcattctcccttacaatttaaaccaaccagcatcattgtattacttgctcataccacgttgctttatgcctccatgcttttgtaagtgctacgcactttgcctggaaagccctcgttctcctgcttatccagctgaaaaacattaatttacaatcagttcatgtgctactgctggatattctctttctagttccctttccccaagctgaattatgtgccctcccttggtattcttataatatctcatgcatatatttctttggttaccatgttttttttttaggattatttaagtgtctctgttactaaactgtgaactctgtgggcatggactagctctgttcttttcttcttagccagctagtgtaccgcttagcacatagttggccctcctaactagtgagcattctgtaacagtgcagaatacagagctctaggacagggaaagaagtaagatttggaaggcctgaaactgtgcacacattcaaagataattaccaggacagcagaaggagctcttgcagaaaaatctttggggccaggtaatttacattatttaacccaagagccagaaaggatgtggggagatgggagctggggtctgaatccaaagggaactttgaaacttctaagaagccagacttagcagctttataaattgaaacttccttgaatttgtctgagtagcctggaataggtatctaagacagttacattttaataagaatatttatagttttctaggagagacatcaccctaaaattgaaaggggcagttgatacaataaccaacacaatatcccaaagcaattattttattgactgtaagcaatgttgtatgctcatgcaaatgttaccagtaagatgttatccattggtatttttgtgcataggtggctggatccagacaaggggattttaggaagccctgcatccctggaagctttcttttctacttgagtttttttcttttttttttttttttttttaagttttgcagaccaccatatactctggatttggtttcatttttccgtgctctaaaatcaacttttttttttttttttttgagatggagttttgctcttgttgcccaggctggagtgcagtggtgtgatctcagctcaccgcaacctctgcctctcaggttcacgtgattcttctgcctcagccttcccgagtagctgggattacaggcatgcaccaccatgccagggtaattttgtatttttagtagagacggagtttctccgtgttggtcaggctggtcttgaactcccaacctcaggtgatccgcccgcctcggcctcccaaagtgctgagattacagacgtgagccaccgctcccggccaaatcaactcttttacctttagattatcaaataactagtcccccgcccatcggtactagattttgctaccttttagggctatgcttcacccatgttctggaaacccacacaaataatacgtattagttttgacagtactttagcttgatctgctttagatgctgtcattgcctttgtcacaattagttaatagagtccactttttttttttttttttttttgagagagagagaaaaggtcttattctgtcacccaggctggagtgcagtggcccaatcttggctcactgtagccttgacctcccgggctcaggtgatcctcccacctcagccttccaagtagctgggattacaggcacataccaccacacctggctaatttgtgtgtgtgtctgtgtctgtgtgtgtgtagagagatggggtttcaccgtgtagtccaggctggtctcaaactcctgggctcaagagatcctcccacctcggcttcacaaattgctaggatgagccacctcacctagcctagagtccacttttgaatgtgtcttatgacagcaaaaattcttattcattatgctgtactacttgcataagagcaactgcattacaatcatcagaatgatttattctttcctaattaacatacatcatatctctatgcaagtagaatcatgaaaatatatggcaatttgtagaatagtttcccttaaccagcctttaagtaaaggacttcctagcttttttgattactcacctttatcaccccaaatttttatcactcctaaaataagtatttataaactacattatttaccactgtattggtcatatattataaagcatgcacaggccaggtgtggtgtctcatgcctgtaatcccagccctttgggaggccgaggcaggaggatcacttgagtctaagagttcgagaccagcctgggaaacatggtgaaaccccatctctacaaaaaataaaaacaaagtagccaggtgtggtggcttgtgcctgcaatcccagctactggggaggctgaggtgggagaattgcttgagtccaggaggtcaaggctacactgagctacgattgtgccgctgcactccagcttgggtgacagagtgagactctgtctcaaagaaaaagcacaaaaatggaaataaagaaggatgagagattaaatgaacttttaaaaaataattctaatatttattaatggtacaataacctttgctctcattttgatgaggccagtgacattaaatgtgcttcatttaaacaaaattttggtttatgatacagctacttgaacatctgattctaacttctgtttatttttatacttgattttaatgactgatgcctcacaaagtatatacattttaaaataaaagaagtatattgtttggatgcacttactaaataatcatactcatattacagttccaggcaccagttatgcaaacattttattgctgttcctgaacctgctgtcttttatgtttttgacaaattgaaaagttaaaacgtgaaacatcttttagataacaaaactgtgtagtaagggaaatatttcaaacctactctgtattgtttattctctattaaaaaaccttggccaggcacggtggctcacgcctgtaatccccgcactttgggaggctgaggtgggcagatcacgaggtcaggagatcgagaccatcctggctaacacggtgaaaccctgtctctactagaaatacaaaaaattagccgggtgtggtggcgggtgcctgtagtcccagctactcgggaggctgaggcaggagaatggcgtgaacccaggaggcggagcttgcagtgagccaagatcgtgccactgcactccagcctgggcaacagcaagactccatctcaaaaaaaaaaaaaaatcttgacataaaatattttagtgtttcaattaatttaaaggctcctagtgtcttgtaggtattctgggattggaaaacatgattacaagaagaaagtttagttacatttaatattaaaatgtttaaaaacattttattgaactacaatagacaaattatatataaagtatacaatttgacaaattttgacatctgtatatatccatgaaactatcaccagaattaagatattgaacatctatcacctccaaaagtttccttgtgccatgttgtaatccttccttcttgtccctgtgtgctattaccctccttacccccgtcaactcctgaaaccactgattctgttttctgacactatgtattttctagaattttatataaatgaaatcatacagtgttttttttttgcctgacttatttcagtcagcataattattttgagattcgttcatgttgctatgtgtatcagtagttcattcttctctattgctaagtagtattccattgcatgggtatactacaatttgtttatccatttacctcttagtaggcatttgggctgtttccagatttgggctattaccaataatgctgttaacatttccatgcaaatctgtgtaggcatatgctttttttttttcccccttttgaggcaaagtctcactctgttgcccaggctggagtgcagtggcgcaatcttggctcactgcaacctccacctcccaggttcaagcgattctcccacctcagcctcccaagtaactgggattacaggcatgcaccaccacacccagctaagttttgtttttgttttcttttgagacggagtttccctcttgttgcccaggctggagtatagtggcacgatctcagctcactgcaaccaccacctccctggttcaagctattctcctgcctcagcctcccaagtagctgggattacaggtgcctgccaccacacctgggtaattttttgtatttttagtagagacggggtttcaccatgttgatcggctggcttcaaattcctgacctcaagcgatccgcccaccttggcctcccaaagtgctgggattgtgggtgtgagccaccacgtccggcctacgtatgcttttgcttttcttggataaataccaaaagtggaaagcctgggtcatatgggagatatatgtttaactttttaagaaactgctaagctgttttccaatatggctataccatttcacattcccactgtagtgtatgagagttccagttgcttcaaatgccggccaacatttggtgcattttaaattttggtcattctaataagtatgtagtgatatctcattgtggttttagtttgcatttccctaatgattaatgatgttgatcatgttttcatgtgtttatttgctatttgtatatcttctttggtgatatgtttattcatatcttttgtctattcatatcattgtctattttttaaatttgtgtttttaaaaatattgtagagttctgagagttctttatatatgctggatataagtccttatcagatatactagttgcaaatattttcttccagtatactgcttatctttttattttctaataaagttcttacaaagcagaggttttaaattttgatgaagcctaatttatcaagttctggatcacgttttacgtgtcatgtcagaaatgcttgctttttttgtttcatatggatatctagtttttccagcactacttgttgaaaagactgccatttctccactaaacttcccttaacctttatttaaaaaatcaagtgactataaacatgagggcttatttccatactctctattctgttcgtttatttgtctgtcttcctgcccagtaccacattgacttgattactgtggatttatagtgtctcttaaaatcaggttaagtttccgctttgttctaccatatgttttgaacctcacaatatatcgttatttttcctttaaacggtcgattatattttaaaagagatttaaataataagaaaaaagtatttttacctacattgttaccattgcatgtgctctgtatccctttttgtaaacctatatttctgtgcagtaccattttctttctgcttcaaggacttcctttaacactttttatagtgcaggtctgctggtgattaattctttcaacttttgcatgtctgaaaaagtctttatttcacctctgtttttgaatgatatcttgctgggtgtagaattctatctaggttgatggttgttttttttctttcagtattttagagaggttgttctgtctttacacttgcattgattccaatgataaatttgcttttatcattatctttgttcatctgtatatatataatgtgtccttccccaagaccccaaccccaccccaccccaccactctagcttcttttaagattttcccattgtttctggttttaagcaatttatggtgtgccacatggtatatttttctttatgtttctggtgctttatgttcatagagcttcttggatctgtgagtttatagtgttcaccaaatttgggccattatttttggtgacatcaatgacatgtatagaaggtagcttgatgttgtcccatagctcattaattcctttttctttttttcagttttttctgtgttccattttgaataatttctattgctatgtcttcaagttcttaactcttttctactgtaatgtccaatttgctgttaatcccaacgagtgtgtttttcatctcagacattgtaccttttatccataggtttgatttgagtctttttacatctcccatgtcccctgcctagctttttgaacatatagaatgcagttataataactgctttgatgactttgtttactaattctaacatttgtgtcagttcttggtctttttgattgatttttctcattattatggatcatattttcttgcttttttgcatgcctgttagttttttactgggtaccaaatattatgaatttgaccttgttgagtactgcatatttttgtattactataagtatacttgctctctgttctgggatgcccttaaattacttggatacagagtgaccctttcaggttttgctgtttagatttgttaggcaggaccagagcagtgcataatctgggctatttcccactactgaggcaagacccttctgagtccttcagctagtgtcccgtgaatcatgacgttttccaatttggctggcggaaacaggcactattcttagccctgtgtgagtgacaggcattgttcttttgaatcctttcaggtagttctttccctggcctagagtaatttcctcacaggcataccatgggctaatcagtcctttgctaaacacttgagtgaaaccttctgcaggcctctgaagatctctttctctttctgtggagctctctcaggtcctctgtcctatgaactccagctacctggtttttttcccagactctcagctctgtctccagaactcagggagttcactaggctctacctgggttcttcctttctgtaccattatctggaaattctcttaagacagtaagctgggaaaatcaaagggctcaccttatgtgttttccatctcagaaatcataatccttcattgcctgatgttcagtgatttgaaaaccattgtttcatgtatttggtacatttgttgttgttgttattgtttcaggcagggtggaaattcattccaccttgacattttataatctccaattatgaccaattaaaatttgtagcccaatttaaattctcatctttcgaaaaaagtgtagacaccatcacatttcttgacgtagctaaatcagttctgaatacccatgttcaaaagtatacagaatctggcatgcagcagtataaatctcacatcagtataaaactcattgatcagtttcggtgtaaaacatagtatcattttaaaaagagcagtttaattcaggcttcttggttaaatgaatatattttgaaagactctggttcactttttcatgttcagtgaggtattgtccattgtccttagcctaaacagcaaaatacttttattacatcactttggcaggatatgataatccattagaatgtatttgcaaaaccatcatataattactacttataactttagagaataatttaatatcagttcagccttttggcccttgagcatgggtcaatttttaagaaaatcttctgtcatctataaggctgtcagcatggttcctcacttcaaaaacagtggcctgtgattaatgcattaaaattaatcactataaattcatccatgtacccaaaaactacttgtaccccaaaagctattgaaataaaaaaatttaaagaacaataacaatagcctgaaactttaactgacgtctagacagtttaactcacaattcatctgcattctttaaaagaaaataaatgtcattttctaagacctagttaagtccgaaagcacaaatgaacatatacaaactgacaaaaataggtaacacttagcattctttgtgttctcattactttaagcactttacgtattttaaaaactcatttaatctttataaaaacaagccccaaaggataggtacaatttttatcttcattttgcaagtgaggaaattgaggtactgagaggattagtaacttacccaaggtcacacagctagtaaatgtggaagttgggattcaagttcaggcagtctggctcaattccaagctttttgtttgtttgttttatggacacagagtctcactctgtcgcccaggctggagtgcagttgcaccatcttggctcactgcaacttccgcctcccaggttcgagccattctctgcctcagcgtcctgagtatctgggactacaggcgcaagccaccatgcctggctaatttttttttttttttgtattttttgtagagacagggtttcaccatgttggccaggctggcctcaaactcctggcctcaagtgatccacccgccttagcctcccaaaatgctgggattgcaggtgtgagccacccacctggcccagagtccaagcttttaaccacagctcacacactgcctcaggaaaacaaaaacatttttctctcagctctattacagctcttcaatttccatgggtttaagtttaaacatgtaaacacagatagatttctgggtaaagacattcactagacttttgttgaactcatactgtgtgtcacacactgtgccaagctcctggggctatgatatccagatatagtacctaccttcaaagaggttacgtctggtagatgtttctagtttgagcataagtaccatatattaccatcttcacttttatgtgtggcctgcatgcaacacagcaaaatctgttgtatttgctgtccagggcagggacattacttgtgtcttcctaattcacatcagttttcattttgggaacaccaatgattacttttaatctgagtactattcttacaaggaattctatattttagtcatctttttaatattctagtctcatgcccaaggtcatatagctaaaaatagcagagctaggatttgaacccaagtctgtctttcaccactattttcattattctatgcttcctgtcaagttttgcctagcttttcatttttaaaattggtctttagaatttgaaataatttgagatagctcacccatccccttcttgaaaaccagttgtgttagtgtttattttcattcattgttattatttctcaatcattaggattaggatatagactggatatatctagttggatatggaattctacatatgtcctttagatcaagcttattgtgttgttcaccttgtctacatatttactaatttttcatctgttatactatcagtaattgagagaggtatggtaacttcccatttttatggtagatttagtttttcctttggttttgtaagtatttgcattaacatattatcctcattttttagtagtaaatatgtataattgctaagtaagccatcttttcttttttttaattttttttattatactttaagttctgggataccagaatgtgcaggtttgttacataggtatacacgtgccatggtggtttcctgcacccatcaacccgtcatctacattaggtatttctcctaatgctatccctcccctagccccccacccccgacaggccccggtgtatgatgttcccctccctgtgtccatgtgttctcgttgttcaactcccgcttatgagagaacatgcggtgtttggttttctgttcttgtgatagtttgctgagaatgatacaaaccaccttttctaaaatatatttttatgggcatgggtcccacaaggatgctatattaagatacttcatctgagtcttgacacctcaggactaacacagaacaagttgtccatctgagctcagattctgacactcatgttacctgagccgtggtcttctcaatagataatcttgcctttttgactgtacacctgggactgaatgtaatgaagggtcttaagttttcttgggctttggtttctctattaaaccctagtagccataaattgggagtatccgattagtcatagcttttctaacttcacatctatctggttttcttattataactgtatttgtgcctccattattttcctgagttctagttttcaaaatatgatgtactatttaccataaaaatatatcacttggtttattgcatatgaaagctgtatttttctttcatattttcctttttgaatttctagagaacattctatgccatagtatggggagtagtgatggtagtgaggtaggaggcaggtattttcctctaagatgttaaggatagatttagtaccattatgatctcttctttgacatgtgggttatttagaagtgtctttataaattttaaaaaaaagtattgtgataagaaattaccttattttaaattgatttcttatttaatttaatttcctcgaagtcagagactggtctgtatgggaaggattttttaaaaaaattatgcagacttgcattacagcctagtacatggtcagttttgggagtaaatattctatatgtgcttgaaaataatgtaattctccagttggatatagattttttttgtattcctattaaatcaagctcattttgttgttcaacttgtctatatatttactagtttgtatctgcttgtaccattcataattgcaacaacaaagaagtatatgttaacctctcattttgatggttgatttttcaatttctctcttttgttcctttgtatatttagtgatgttttattagtgggtgcatatttattatctctatgtagtgatcttatctaacctttataaagcttttattgtcttttttacttttagatattaatatagctacctcagctttcttttggctagcatttacctggtatatcttttcctatctttttactttcaattttcccttcaatttatgttttagatgtgtctctcataaatggcacataactggattttttccttttatccagtctgttaattcctgtatttcaaagggtgaattttgctcatatatgagtttcatattcattgatatacttgaacttgtttttaccattttaccttttgttttctctttgtctcagttttttctgcacttacctttgtcttcttgccttttaatttttgttcttaatttgttttctgctcctcattactgattctgcaagatcccattgcaaacaagctggctgttaacagggttagtgttggaaacaacagcaacctatggtggaaggtggggcttggggtgggatatggcttttctgaaaggagtcagattggcaagtgatggggaagaggaggcagggagctgatagagtccatgtctgatggtcttacaaaaacctttttacaagtatgagacaagcatgtctgatgggactggagggaagggaagtgggagtgtgagatgaatgaaggcttgaatagaacccaaagggactaggtaaaggaattgaacaagcataagtaacagaatttatgggtgacaatgagggttcagctgaggttgtagaccaggaattatgtagaacctgggtataggagcagacaaggcaggctagagcattagcacaggtttgggattttcatgggcagttgtggcagagggatgaaggtatatggatatggaaggtactggtgagagtggttcaaatgttgagccatctggagtccaggatgggtatggggggaagatagatcagcagaaggcaagtggaccaagagacaatgtggggctcaagagactgtggtcttgataaagttgaagaacagatagagcaggagtgagctgtggttggaaagtgggaattcttgaatttaagatttcagagggggcagttctggttggtcaggtccataaatgaaaaagaaagggcagatgtacaatattggtagttccattttcttaagatactatctttatttcctcaaggatcttcttacttccctggattttgatattacttggtctcattattatgccaacgtgcctttctcatcacaatattctgctgcctctccacaagcaccagtttttaaatctggtatggttctcatttctagtgtgcctgtgctatccttgctttttagctgacaggtaactgataatacctcttttatccaggagccactgatttttttgcgcagtgtttcagccgtaatcacacatatgggaattcatttccacaatgcttttgatttgtctgtttagtactttatagttgctttggttataattctgcctagactgagcctgtagagcaccaactctggtgtcagattgcctgggcttgaatccctgcaatttcacttacttgctctttattcttgggcaagttagcctaacctctcctgaatcctaatctatacaatgggggtaataatagtcactcattcttggtattgtggcaaggattaaattagttaatatatgttaggtacttgtttggcgtatagtcaattctcaataaaagatactgttggggtgacaatgacagtgattgcaatattggcagcatatgcaaaattgcataccagatattgcattaagtgctagggcagatacagaggagaagattgaaaaagtccttgttttcatggagggtatatattctccttggggataagaactaagaacacttcctcaagactgtctaagaaagggtgtgtgcaagaggcttaacatcttatagttcaataaagaccaggaaatatacaagttgaggaaatattgaggtttcaggaacctgtatagctttgccgtgttgtttatgttctccactgttttgtagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcagatacattttttcttcctgaggtccagccctgtgtctccaactatttcctgggcccagttacctggatatcaagtatgcaacactaacttaatagggttaaaacaaaactttttgccttacttccaaacctgtttctttccttacatcttctattgctatgagggctgtcactagccagtcagttgtttaatcttgactgtgaactaggcatctttgacttcaccttcttcatcctctctgctcagtcagtctccctattctgtcaattctacttctcaaacctattctgttttttcttgctgcctggctcaggcctttatcattttagaagattcagcaagtatttgtactccaaacattgtgattggccctttaacacacattatttaattttttaaacaacgtttgaggtgggtcgttttgtagatgagaaaccaaagagtcagaaataaaatgacttctgctgggcacggtggctctgtctatagttccagctacttgggaggctgaggcaggaagatcacttgagcccaggaatttgagtccaggctgggcaacatagtgaaactctgtctctaaaaatgaaaaataaaatgaaatgaaaaataaaatgactggtctaattgtttagaggcacagttagtaaatctagattgtcttttgctgcagtattgtaataatatctctgcctcatttgtattgttttcttttttgagatataaatggaagatatatgtaaaaacaaattagaactatgtgaagtaaaaagtgaaagttgccccttcccaattctactccccaagggaaaccaatgatagtggcttttgttctagacctttctctttgcatatacaaatatttagataaattctttataaaagatcattttttattgtcctacaactactttttcactcatggccatatttttatgtcagtacgtgtgtatctaccacatttttaatggcgacataatgttccattatggggacatattattttgtttaatgattcctatgttaaataactgtttctgttcttacaaataatgttgcagtaatagtcttgtgcatatactcttgcttgtgcatttgtatgaatatttctattaggtaaattcttagaagtcatattgcttggttaagtatatgcctattttaaatgtatgtactaccaaattgtcctctgatttgtcctctaaatcagtctttcatattataactagagcgatatagctataatatgtctttgtaaagtgaatttcatcatgtgatttcccagcatcaaaaagcaacatcagagatgtttggtggatttctattgtctatgcagtaaattttaaaattaaaaaaaattttttccagacaggatcttgctttgttgcccaggctagagtgggccacatgtgatggcgtgatctcagctcactgtagcctcaacctcacaggctcaaacaatcctcccacttcagcctcccgagtagctgggaatgcagccgtgtaccatcatggctagctaagttttgatttttctttttgtagagactgagtcgccctgtgttgcccaggctggtcttgaactcctaggctcaagagatcctcctgcctcagcctcccaaagtgctgggattacaggtgagagcctccatgctgagccaaaattcttaaaattttaaaaaagtttttaagagttatgtaatctggtcccaaactatctttcctaccattcttccctaccaggaaatttgtcctctgataaggcaaaatccacctcttctgtgaaatttcccatgtatactgctctctttcctctctctatgcaagatagaatgagttgctttcttccctaagttctcatagcacttaatttatagtcccttataatccctctgatagcacttaatgcgttgtactgtatttatgtgtgtctgtctcccctgctactctgtgattttcataagggtaggaactgtgccttactcatctttgtatccccagcactttacacaatgcctgtcagcgtagtgctcaacaagtgttcatgaatttgggaaagatatcctggaggtagtgctagagtgctagtatgataagaactttgagagatagagtagggggtggaagttttgaagtatagcagaaagctgactgactcctgggagaatggaagctggttaggaatagacaactgggcttaaactggcaggagccttcatgtgcttttctccttcactgcagagaccagctgcctggttatttgggttaataggcttgagatttgagaacatttaaagtattaaaaattggatgattgaggactcacttggtggagggggagattgactcagctgttctatgttctttccagactaagatgcatatactgaataaccaatccttttcccagagtcacgaataactttttctttctgaaaaatcaaggactcttcattttcagggcatgtttcggatgggagtaggaagactaaataggtcagatacttctactttgtctctttagcttggctcaaggggaaaggaacctattgaaagggtttagggctgtgggcctattcttgagtaaatcatctgtgtgaaattagttcttttgtcatttcaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggtaagagttccccaaaacgcatggggtcccaggcctttgaccaatgatgtctgggcttttccttatgtctcccacctgactttcataggaatttgtatatgtgatgtttaccactacttattgggtcacgctgggctctgagtttgttgcttccacagaaccaaatagtcttactgtctttacctctcaacccctctccatccaatctatgcatatcctgaatccacttacgcttctgttttgggtcttggcaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatgtgagtgtcacctatggctgagtagagagggggcgaggccttggccgtggtgagaatttctttcctcagcctttattagacaagaaccattctttatccatctgtcattttcttttatttcttcccagagagttgaagaaagcaactggggactggttttatgaccagaaagtgaatcgctttgcttaccgcacaggtagtgagataatcaggatgtccctgcgccacaaacctgcaggtactggacctgtctagagatggttcttggtatggaatcctagtgtattctgactggtagcatcttaactccatgggctcagccagttagtggagaatagaagattgtattgtcatcccttctgcaagcatggtgtatttcaggggatttgctatgagggttgtttcctttttcccctactcataaccaccaccctggcatacttttctttgtcttgaagtgagtaaaagagagacagtgggacagtccctccttcatcagacacagatgggtgacatctggccaggaagaaagatcattcaggagcggcagaaggagcccaggtaagaatcaagtaattgtttaaagaaatgcttacaatatccctttaattcttttactattctttttacttcttctgtttataaaataatagatgttcattataggaaaacttgaaaagtacagaaaatagtaaaggagggaaaaaatcattcctaatcccactactcatatgtagacattaacattttggtatatttacttagttctttattttttatagtttgcattcgctttctcaggttgaatagtttgttctttatacgaacaatttgaagacaaataaaaataacacatgctcattattaagcaacaaatcacccacattcctactaccccagttttcacattatgtgaaaattatttcgtatatcttctatgtatatacataacgggttgactggatggataaactgaaaaatctttttaatattggatcatagtataataaattaaaatcatcctatttaattttacttgaatttaacagaataaaacactgaaataaaatgaaagaatagctaatcttcagacaaatgtttttttaaagtaaaagatattagttgttaacattcctctaagcttaagaaaaaatattatgaaagccattgagcagttggtcacttttttagtggagtttttttggtaacagccttattgagatatatataattcacatactatacaatttgtccatttttggtgtacaatgcaatagtttttagtatattcactgagttttgcaaccatcccttgaatcaattttagaaaattttcatcacctcaaaaagaaaccctttacccttttagctgtcaccctccctgatccctaaacaatcactcatctactttctgtctctctgtatttgcctatcctgggtatttcatgtaaattgaatcatacaatatgtggtcctttttgacttgcctctttcacttaacattaacgttttcaaggttcatccatgttatagcatgtatcagaacttcattcctttttatagccaaataataccccatgatatgtatttatcacattttatctgttcatctgttgaagaacatttgggttgtttctactttttggttattaagagtaatgctgggccaggcgcagtggctcacgcctgtaatcccagcactttgggaggctgaggcgggtggatcatgaagtcaggagatcgagaccatcctagccaacatggtgaaaccccatctctaccaaaaaaaaaaaaaaaaaaaattagccaggtgtggtggcacgcacctgtagtcccagctactcgggaggctgaggcaggggaatcacttgaacctgggaggcagaggttgtagagagccgagatcgcgccattgcactccagcctggcaacagagtgagactccgtttcaaaaaaaaaaaaaaaaaaaaaaaaagagtaatgctgctatgaacattcattaagagttttgtgtggatgtatgttttcttttctttttttttcttttcttttcttttttcttttcttttctttttcttttcttttcttttgagacggagtttcgctcttgttgcccaggctggagtgcagtggcgccatctcggctcactgcaaccttcacctcccaggttcaagcgattttcctgcctcagcttcttgagtagctgggattacaggcacgcgtcactaagcccagctaattttcatatttttagtagagacggggtttcaccatgttggccagactggtcttgaactcctgacttcaagtgatccacctgccttggtctcccaaaatgttgggattacaggtgtgagtcaccatgcctggcctgttttcatttttctaaggtggatactttggagttagccgtcattttaaaaatctgcctgtttcaatatttaacattatcagtgggcgctttgctgtgaaagaggaagcagttagctttcttacacttcccccggttattttcttctatccccactatttgttactcaaattatttttcctttgtcagggtttataatatttacattctcttatataaccataaaccatctgtttgttttatctgtttgtttccttttagttttatacttaaaaggattgtatgcttacaaccaggccttataccacaacttctctatttctgatttatttcttggttttctggatttcatcattgaggaggtccttcaagaagagcttgcaggtgctatatttattgtattcttacacgttaagaatgtctgccagctgcctttatacttgaatggtatcttggctggatattatattcttgggccacattttctttccctcagaatgttgtagacattgttccattgtcttcttccattgaatgtaactgtgaagaagtctgaggacatcttggcccttgtctttctttcttatggatgagagagagagagaaagagaaagagaaagggagagagattggacttgcctgaaaattttcttttctttttcttgaagtttagtaatttaagggctgggcacagtggctcactcctgtaatcccagcactttgggaggccaaggtgggcggatcacaaggtcaggagatcgagaccatcccggctaacacggtgaaaccccgtctctaataaaaatacaaaaaaattagccgggcgtggtggcgggtgcctgtagtcccagctgctggggagactgaggcaggagaatggcgtgaacccgcgaggcggagcttgcactgagccaagattgctccactgcactccagcctgggcaacagagcaagactccatctcaaaaaataaaaaataaaaaaaaagtttagtaatttaacaaggttgtaactcaatggtgatcattctgtatcatttttccctatatgtgatatatccttgatgagttctttcttcattgctggaaaatttttctgtatcatgtctcagaactctttttctttctgttttattatttaagttctccacctcagagatactggattttcttatcctctatttttgtcattttcttttactagcgaatggaataggaaaaatggtgaaagcaattaactgtgattagcccaacccattcctccatgctattaatttggttttcagtttatttccctcccctaccccttttcccctcccttccttactttttgctgcttctaatttaattatttgagtaaattatcttatttaggttttgatttgttctttgctctaatcttctttctctcattttgttttatcatcttgtatttgaattcttgcactttattgaatttatattattagttcccctgtagtgtaaagcactcacatgaaacctacttgttttcctagggttaaattcttctccagactcggttcttcatccatcttgcaaattgttttcatttctctccacttcatggctatttatatatctgccagactattatttcattttactgaactttaatatgggaagttttgtctgtatcttttgtttcctctgatatagcatatgtgagttcttctcaccttaacttgaaacaatttatcttttccccattcccagctgtactttagtttaaggactgaatattgctttttatatttctttccttgtaacctgaaggggtaggtgcagaaggcaacttggagtcctgagttttggtctcatgaaattctcttaaatgtcctggttcagggcttacctgtcccagatctgggttaatcccctagctcataccagtgccctgggagatgacattttgcatcagtcttgtctgtctctgttgaggttctacagtggtacctggggctataaatcttgaggacttctgtttttcttgactactcactcacttaatctgcaaattgctacattggaaaggattagttaaggagctttgctgaattaaatcttctgttttcttaggtgcgatttttgaaatctgtgacttgaggctttatttttgactcatttggttgtggcggtgaatttttagcttttgtatggtgtgtgtgtggtttttttttcccctaactttcactcacccaaagggaaatgactttatcatgtttcatatgattgttgaaaaacagcatagaaatgtataaagtaagtcctccagtaacctcactgcttcttccccagataattatcgttaatagttgtgaatagttttggcatatggactaccaagctgtctaaatatacatatatgggttgggttcctaagtttttaatttctttttctttaaaggatgatactataaacatgttaagtgaaaaaaagtgaaagaaaaagaactttaaaaactcaataatacagacaatcccatagaaaatgcacaaaaaatttgaacagacatttcaccaaagacaatatagagatgtcagataagcacatgaaaaggtgctcaacatctttagtcattaaataaatttgacctaaaaatcacaataagatactactacatacccattagaatgactaaaattaaaaagactgaccatgccaattgttggtgaggatgtaaaacaactggatttaaaaaaaattttcttttctacatttcctccttgctattataaacaactagcattcttatacactgctggtgggaatgtacaatggcatagctactttgaaaagcagtttagcagtattttaaaaagttcattgtgcacctaccttgtgattaagtcatttcattcctgggtacttactcaagagaagggaaaacgtatgtttgtacaaagacttctacgtgaatgttcatagcagctttatttgtaatagcccaaccctggaaataacccaaatgctcatcagcaggtgaatggataaactgatttgtttatacggtggaatactactcagcaatggaaagaaatgaactattgatacacgcaataacatgaatgaatctcaaaataatcatgctgagtgaaagaagccaagcagtaaagagtacatactgtatggttctgtttgtataaaaactagaaaatacaaactagaaagcagtgacagaaagcagatcaacacttacaggaagggcaggagggattagaatggggcaggaggaaacctttgggagtgaaagatatgttcattaacttaattgtggtgatagtttcgcagatgtctacatttgtcaaaatgtcacgttgcacacttgaacatgtgcagcttatttatgtcagttattactcaaagcgtaaaagaaaaaaattgtagaaggatataacatgaacatctttctgtgtcagcaccaaggatctgtttcattcttttgacatctgtatgatgtttcattgtatatatggactgtgatttttatctacacagccttgggtgggtgactcatccgttccaggtgatgaggcccccttttttctttgtggattaaggataagaatggcttttatttgctgaacctgattaacacatctgacatcatcagtcagaatgtaatttctgaaacctattgcttctggttgtctgtgatctcttgtctcattggacccagaagactcttatttatcctaaacatgaaaacagattaagtgaccataaatgatctttcccatgaaattatggagcctcagagataatttaattcaaccaccctatttttgcagaaaagaaagcaggataagtgatttacctgagatcatacagatagttagagcccagggctcccatctcttagtctattttttactgcacagatgtcaaataattgcttttctgcccttgggttgtttgtattagctgtggattggtatgtattaatctttaggaaaaaaaggaaaaaccactctccatggaccattgttaaaactacctctctggaggaatggttctgcttgggtttttttggcgggggtgggggtggggacaaaaggggaaaaaggacaattctaaagtaaaaaatgaaatcaagcccccctgctatgtcttgtgctatacaagtaatacatctttcaaggaatgactgacatttcacctcttgtaagtactaggatttcagccctgctgtctgttttcacagaactgtcaaacatcatgtgacaacttggagagtttattctttactggctaagacattatagattttggttacctcattctttgtgcatctattagtttgtttgtttgacaaatatctatgaatgcctactatgtgccaggcattgttttagaccctgagatacactggtgaatacaaggcctcttgtttgtggggcttagatttccggggtgggagataaaaagatagtcaagtaaatgtatggtatatcagatgttgacaggtgctgtggagaaaatgaagtagaccaaaggtatagggagtgccaggaatgaatgtgtgtacatatactgtttaggatagccagggcaagtcttaacaacagggtaacgtttgagcaaagatatgaaaaaaatgagggagcaaacccttagggtatctgggggaagagcatgtagatagagaaagaaggaggtataaagaccctagggtgagattttgtttggcacttttgagtaatctgaaactgagtgagcaagggaggctgaggaaggagttgaggacagagatgggatgagaagcagatcatgttaagactttggtggcacttgtaagcattctgtcttttactccaagtaagaaggatggctctgaggggcacagccttattttgtcttctttttaaaaatggaggtaaagttgacataacataaaatcattttaatcaattttaaagtataaagttctgtgattgttagtactttcagaatgttgtgaaattagatcaccactatctaatttcagaacattttcaccatcccaaatagaaacccgatagccattaagtagccacctccatttaccccagcccctaatatgctttctgtcttgatggatttgcctaatctagacatttcatataaatgcagtcatgcaatatgtggccttttgtgtttggcttatttcaattagcataatgatttcaaagttcatccatgttgcagcatgtatcagaatttcattgtcttttattgatgaataatccattatatgaatataccacatttcatttgtctaatcatgcattgatggacatttaggatgttttcatcttttggctattaggaataatgctgctatgaacattcatgtaacatttttgtgtggacatatattgtttagttctgttgggtaggtacccaggaatggaattgctgggtcatatgatagttctatccctgatttacattttaaaagctcattttggctgttgagggaaagtcaaagccaagggaagaagcaggattagttaggaggctactgcaaccatccaagagctacatgatggtggtttggaccagagtaatggcagtggaggcagtgagaacgtatcagagtctaggtatacattgaagaggatttgctgacagatttgatttgtattgtgagaaaaagaggagtaaccgatgattcttagcgtttttgacttgagaaatgaaagggaattgccatttgatgagacagagcgaagagcagttttgggggaagattagggctttggttttgggcttgctgtgtttgagacatccacgtggagacattgaggaggccattggaaaaacaagtctggagtttgagtaagagataaatttgaggccgggcatgatggctcacgcctgtaatcccaacactttgggaggctgaggcggatggatcacctgaggtcaggagctcaagaccagcctggccaacatggtgaaaacctgtctctactaaaaataaaaaaattagccagccatggtggcacaaacctgtaatcccagctactcaagaggctgaggcaggagatcgcttgaacccaggaggtggaggttgtagtgagccgagattgtgccactgcactccagcctgggtgacagagactccatctcaaaaaacataaaaaataaaaataaatatatttgagttattagtttattgaggatatttaaagccatgagactagatgagatcatttagggataattctagatagagaggaggagcagcccaaggaagaagtttggacataatctaaatattagaggtctacgggaggaggaaggactagcaaaggagactgagaagcagcagccagtgaggttggaggaggaaaccaggagagtgtggtgtccggggagccaagggaagttatttgagatatttgaggaagaatcgatgttttttcccccttttcctgctgctctcactaattctttgaggtaaggggccgaggaaccgtatccttcccttgaaagatgagaactggtattttgaatgcccagagtcatccttcattaaggcgattaagctaaaaaaaagaattctggtcacctgaatactgtcttctagacatactgcttatttatggatatatctcagtcccactgagggcatttattcaataattcagtcaataaaaatacttgagtgcatactctatgctagtctctcttcaaggcactgagaacacatcagtaaataagatacgtggtcactgatcttatggaactttgtcgaatggaggagaaagacattaaataatttgtttaaattattgaaccaaataaataatttgtttaaaatacataaatagttacatatgtggtgactgttactaggaaatcaggatgctatgggagcacagaggaaggttactaatcgagacttagggtgggggcatggccagagagatctggaggaattgacatataaggagagacctgaagcaggagtagattgaggcaggtgaagaaaagtggccattgtgaaaagaatatcttaggcagataaaagagggaagatggagagcttcaggatattcagagaaacaaaataactttgtctttctaaaatataaagcttgaaggaggagtagggggtgaaaaatgagactggagagggtgagcaggggccaaatcatgaggatttcttgccatgctaaggagtttcagctaaatcccaacagcaatggggaaccactgaagagttttaaaagtatactgagggccgggtgtggtggcttacgcctgtaatcccagcactttgggaggccgaggcaggcggatcacgaggtcaggagatcgagaccatcctggctaacacattgaaaccccatctctactaaaaatacaaagaaattagccgggcatggtggcacgcacctgtagtcccagctactcgggaggctgaggcaggagaatggcgtgaacccaggaggcggagcttgcagtgagccaagatcgcgccactgcactccaacctgggagacagagtgagactccgtctcaaaaaaaaaaagtatactcagctgggcaccatggtacatgcctgtactcagctggtacaccatggtacagttactcagaaggctgaggcagcagggttgcttgagcctaggagttagagactgttgtgcactatgatggcacctgtgaatagccacagtactccagcctgggcaacattgcgagaccttatttcttaattaattaatttattatatgtttaaagtatactcatatttattttagaaagatcactcaggctacgattgtgaatggattggaaagaggcctgactagaggcaggagaacctgcttcctttcaatattggctcttggtttttattctagtgtgctatttgaagtgccaaagctgaaaagtggaaagagtgcattggaagctgagagtgagagtctggatagcttcacagctgactcggatagcacctccaggtggggttccccccatttccctcatctcctctcaacccaagttgtgattttgttctgcagcatcagtgttcctgacttctgtcctcaggaagttgaacgaagtattttctctgtcctcaacagaagtcttttcagtagcacgtctactgatttggctctgagcacagcttcctggaacacattgacatctctagtcaattcccccagtatcttggagtattcttcttagcccagtagcaactgatgctgctgtcccttaagaatgagggtgtgagtgtttgtgtttgtgcaaagttgcctatctgatcttctgcattccttccaggtaaatcacatgcgaagtgtaccttctgaatttggttattacgatgacccaagccattggctctccttccatagagctttgatccctgggtagaaggggaagggtaggaggtgacttagttataatttctgaatctacctccaggagagactctctggataaatctggcctctttccagaatggaagaagatgtctgctcccaaatctcaagtagaaaaggtaagcttcaggttattgagccaccttcctcccctcccttccttccctttctcctttacctcctgtctccctccgtctttccctccctccctccccctcactcttctcttcctctttcttccctccctccctccattctcttaggcagaatttaaatcaggaatttcaactaaacaaatttcagttcaaattcacttgggagcattttctgaagttttgtttgaaatgtgtgagaaaataggttttgtactatttctaggcatttaatctttcctttaagtttgtcatagtttagcgaaaatctgagccttattcttcttaagactgtccttccttactcactccttctacctatccatctgttcttttccattttcttgcccttgttccttcctaggaaactcagcctggaggtcaaaatgtggtatttgtggatgagggtgagatgatatttaagaagaacaccagaaaaatcctcaggccttcaggtaactggtttcccttactggtctttcaggactgaagttctgagtacccttgatgggctcttggtatggagaagaataggtctctttgatttggcttttttggtcttcccctcagagtacactaaatctgtgatagatcttcgcccagaagatgtggtacatgaaagtggctccttgggagacagaagcaaatccgtcccaggcctcaatgtggatatggtaggtgcccttatattttacttggtcactatatgaaattttacttatctggagttggctttagtacctgatattctcagtcaacctatttaattctttaagaaaaggcaacatgaaacttgatacccccaagtttctaaagtaaatctggttcctgatttgcttaaaggaaaggactgtctttgctatctcttttttttttttttttttttttttgagacggagtttcgctcttgtttctcaggctggagtgcaatggcacgatctcggctcactgcaacctccgcctcctgggttcaagcagttctcctgcctcagcctcctgagtagctgggattacaggtgtgcgccaccatgcctgggtaattttttatatttttagtagatatggggtttcaccatgttggccaggctggtcgcaaactcctgacctcaggtgatccacctgcctcggcctcccaatttttttttttttttttaagagacagcatctcactctgtttcccagactggagtgtagtggtacaattatagctcagtgccaccttgaactcctgagctcaagctgtcctcccacctcagcctcctgagtagctgggactataggcatgaaccatcatacccagctaattttttttttttttttgagagatgggagtctcactgtatttcccagcctggtcttgaactcctaggctcaagtgatccgcccgcctctgcctcccaaagtgctggaattacaggcatgagccatcacgcctgaccatctcttttattttctaataaattgctggatatatggctggggctcaaataaatacttcttttgattaaaatgtaaacagggttggggaaagtcaaatggaaaagagttatagcttctatgaaaaacattaaatattcttatcttattcttttgagatatgagaaggatggttggaatagagctgggaaccctgaaatgggaagacatgtaaaaagaaggatatgaggccaggcatggtggctcatgcctgtaatctcagcactttgggaggccgaggcaggcggatcacctgagatcaggagtttgagaccagcctggccatcatggagaaaccctgtctctactaaaaatacaaaaattagccaggtgtggtggcgggtgcctgtaatcccagctactctggaggctgaagcaggagaattgcttgaacccaggaggcggaggttgcggtgagctgagattgcgccattgccctccagcctgggcaacaagagtgagactccgtctcaaaaaaaaaaaaaaaaaagaagtatgtgtgcgtacacatacacatggcaacttggagctttaaaggaaagatattagtctttgaagctaaagaaaagtctttcttttattaactctgaatttatatttattgttccaggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaaaagaaagaaagaaattttgtattaagcagcacagatatgcatccatgtatttatatgtatttttttctttttttacacaaatgggttcacatggacctcattgtacacatttttttttttcatttatcatgggcatccttttgtgccatcacttacagatctatctcattttaattgctgctgcatagtattttttcatgtgcctgtattataatttatttaccattcccccactaataggcctttaagttgtttgaattcttttttgctcttaaaactatgctgtaatatatcttggtcttcttttgtgaatgtaactgtcagagaagttcctgttggtggaattgctgagtgaaaggaaatataaatccaatattttgatagctgttgcccttgcaaaaaaaaatagtgacaacattaaatttgtccctttaaatactaataaaaacaggaatttgttcaacagcacagtaggatgactatagtcaacaaaaatatttgtatttcaaaatagctagaagatttgaaatgtttccagtgcaaaaaaatgataaatgttcaaaatgatggatgtaacaaaatatcacatgtaccccataaatatatacaaatattatatgtcaataaaaagacaggaaagaaattattaccaaagtataacatattattacaaatttagaattttttaaccatttggcacccaagtcattctctacggtcaatataattatattggaaatgtcactgtaaaccatcatgaactactgccaataaaacttttatataaagagaagaaaccacattaacatggaggtctttgctctttgtaaatatttggagccagaataagaatgtgctactaaaacaaatatgccagtttctagctaatgctaaactccaatttttaagagtccactgaagttcacagaacttttctaaaaaataattttctagaaattaataaattgtgtagacattttataaacaacagaaagaccattcccatattatatatcgattttaacttctacatttgttgtttctggttttgtttttgttttttgttttttccctagcaatccatttgctcctattcagttttcccttgcctgcatctacctcccgattcttttgtctctctcacatatattaaactgtgtgttctgggtatgtggtatgttgatccaaacttatggggattatgccttcctagcattggtaaggacctaagttagaggaaccccaattaacacaggcaaggccaagtgcagtggctcctgcttgtaatcccagcactttgggaggctgaggtgggtggatcgcttcagctcaggagttctggaccagcctgggcaacatggcaaaaccccacctctacaaaaattagctgggtgtggtggtgtgcgcctgtagtcccagctactcgggaggctgacgctggagaatcacttgagcttgggaggcagaggttgctgtgagccgagattgcgccattgcattctagcctgcctgggctctgggaatgaaaccctgtctcaaaaaaaaaaaaaaaaaaaaaaaaaatacaggcaggtgaaagggcacctctagtctgcaccagctcatgctctggatactaaagcacaaggaacaaagtcatgccgagagagccaatcgagtgaagcagttctgccaatcaaagccaaagacaataggccacctgctgctcatctcagacattcattcgttcactcttaccttcattcagtaaatatttgtggagcacctactatgtgccagatactttgctaagtgttgggcatactaggatgaacaaaaataggcttgatttctgtctcttggcacttcggctgcagtgttagagacagacattgatcaaagataacttaaatgcaaaatttataattgtggcaaatccaaattcgtgtaacagagtttcacctagccctcaaatctttgcaagccctccttttttctttttttggggggagggacagggtctggctctgtcgcccaggctggagtgcggtggtgcgatcttggctcactgcaacctccgcctcctgggttcaagtgattctcatgcctcagcctcccaagtagctgggattataggcccacaccaccccgtcggctgatttctgtgttttttgttgagacaaggttttgctgtgttgtccagactggtctcgaactcctggactcaagcatttgcccacctcagcctcccaaaatgctgggattacaaatgtgagccactgcacctgactgaaagccctctttttttttttcccctgcaagccttctttttaaaaataccttgtaaaaatactttgtatttttaaaaaccatacaaatgatatatactattctcattaaaaggacactaaaagttaatatggagtaaaaaagggaaagttgtctttcatttccctattctgttgccctccctagaggaaacgaggataagtttgttcgtatcctgggtttttctatgcagtgtagtataatgtttaaaagcacggactctggaaccagtctgtctgaatttgaatcctagctctgccaattactaactgtgtgaccttgggcaagttacttagcttctctgttcctctcttccatcagttgtaaaatggagttaatagtacctgtctcatagagacagtcatcaaacaaaatgatacacctaaagtacttataacagtgcctagtacatagtaagggctaacataagtgataatggcaatcgttatttacatacatttatattcacatgtacaactatgaatatattttaatataagtggaacatttttctgcatcttgctttgttgacttaaccctatgtcttggatatctttccatgtcagcatgtacagattcactgaattcttttttgatgactgcatgccatatgccataccaggacactacaattattcatttaactctttctatagtgattgacatttaggtcgtttccactttttggctattactaacaatgctggtagcaagattctctgtcatgctgtcagtccttcgtgagtttgtatggcaaccttgcttgaagatctttgagagtatttggaatctagtaactatgcccccaaagtggcataatagtgggtattgcagaagactctttgttggttctgccctatttccttctaaagaaactgccatagaaacctgtggctgccatggcctagggacggtggattatattcatatgaagaaggatcctcttttgccctgatgctgttcttggggggtaattttagaatttttttcagagagaagtcccaacaattcttgagaagcccagcttgacctgttgggtttccctgtgtttcagatcagtgctgagtccccgactggcttgccatcacacaaaggcgagttggtggtttcattgaaatacatcccagcctccaaaacccctgttggaggtgaccggaaaaagagtgagttttctttggggtcctggatgtagcttagtcttctgcataggatctgtgcaaggccggtgctggctactggttagcactgttggagagaccaaattgggatgctccctggatctgctagggagattcctttactaaggaagcctctctgcgttttttcaaacagaagggaatgccttagggttggcattcttttctttttttaggctattaaatggacttggtcttggtccagctgtggcaagctactaagagggcagaagagaacagaaactttggggctgagaagggtggctgggagaggtggtaaagtatgaaggacaggaagttgaaagctggggaagagtaattcaacatgccagctgctgtgttagtgactacggttgtgtagatgagtaaaacatatttgctttcccttgaggagcttaagtttttgcaagaaagacagtcatgtgctaaaaggacacagatataggagtggtgaattatgtctggttacatttgggagagctttgaagaagtaacattaaaactggatcttaaaactttaccagacagaaaaggagcaggatgaggagagaagagcattttcagaagaggggataacatgcgcaaaggttttaaaaaggcatggtaatgtggggttgtatgtgagtgtgtcccttattttagtgggactggagttctggtacactagatgtaggtgtggggctggagttggacatgaggtgggagcctgactgaagagggccttgaacttaatgataaagagtttcacttgatcccttggcaatgtgtggcctacgttctttgaaaaaatatacctttggcagagtcacatctagaaggtttgggggaatcaatgaaatccccaatgagggtatgtagcatgactagagaagagaggcaagtatagaaccagagagatcagcaacattttaaaggatgaagagagaaagaaacaccagtgaagtaaaaggttatcaggagagagcttcaagaagaaggggcggaggttatcaacagtattgaaatactacagggaggtcagaccagatgaggtctgagaagacatggccaattggcattagattgcattttcagtggatcagtgaaagcagaaaccagatttcactagaaactaggctgagtgaatgggcaaagaagtagaggtggtaagtgtggactttttttcctcaggataattgatggtgaaagaaagtagagacatggagaatagcttgaagaagagataaggttaaagggagcttttcttttagaagtactttttcaaagagatgagattagtatatatttagactgaggggaagggacaagtggagaaagagatatttaaattgggaggtgaggattgaaattgatgatgtctgaagagtcctgtgaagtaggggtggaatcgagaactcagatggaggagttccctcttttttaaatcattgaacaaatatcaggcaactttatgtctctaagcctcaattttctcatgtacaaaatgaggacaaaaatagtgtgactctcctagggttgttttgagaattaaatgcttaacatggtatctggcacatagccagttttcaataggcatttattaatattgtggttgttattaatacagcacctattgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaaggggtgagtccctagaccagccccaaattaaccagtttcagaacaagagagctaagagaagaatttaactttctctgtggatattatccagtgtgtcttaccactcccggcaaccaaatttgttcctgaaattaggtaatgacaaaaccttcaccacctttgcactggtctgggctgtagacttgataatccaaagaggagggctgcagacaggttctgacttttgtctgactcatgttcttaattaattctgggtgaaaatctgtgtcttctgactgtctagatttgggaactcagggctttgtttcccacagtttttaagctttccgaaaattacagattacctactgacttaatttatctagaaatcatgtttggctaagtttatagatattactattggttttatttaaagagataaattgtctagtagaaacaaagccaaatatttaaaacccattttcagtggagcacagaatagcctcactaatactattatattcattttctctctaggttaaaggaattgaatcaggtgaatgatctagtagaggtagtgggaactctgcttcagcagattcaaggaggggcgtgtgtagtaggatctggatgtgggttcatcttcttgggctaggcctgtggtaggggaaaggggaatttagagagataactgtccgctttgagtaggctgttgattactccccgccctctgccagatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactggtgagatcccctcccccatcctcacttgtttgaaggcttcttgtctattttactcctattaccattcccgccccccaacacaaagctcctctgtgatgacagttgtcttctttcctttcagttaacattcagccaatacttattgagtgcctactatgtgccaggactaggggaaggctgagctcatgcactgatatgtgcacagataaatgtgaccctgattgccaggaacttcataatcttcccaccaaaaaaatctacaaacctacctatatgtatgtacctatacattccatcttccatgctgttaataatgaaagaagggtcattgctagcaaaagccaagctctctccaagtgctctgggccacctccccctacccttctcgatgacctcacttctataatcgtcatctctcagtttcatcctccctacctaccaggggtgaatacagatatgctctggtatttccaatcttatgaaacaaaaacaaacctttccttgactacacgttccccttctagtttcttagaaagaattgtctccacttctcacctctccttcagctctccttcactgtgatctggcttttgtcccaccactctgctgagcagttgctcttgccaaagtgttgttctcatctcactagaattttcagcactatttaacatgctagatcactccttttcgcttgaaacgctgaacttctattgacactgcattctgattcccttttaagtcactgctcaccccttctcagttttctttgtaggtgctgcattctatacccaaactctaaatgttggtgcttggcagagcttagtctcggatcctcttctttgccctctccctagtctctgcacttgtctattaatatacttatatattaataatcacacagaatatttaacatgaagcatatagactgatgtttttacacatgtaagccaattcatgtcagtcccctgttaaaacccctcagtggctttctgttgtgcttagaaaacaatccaaagttcttaacatgcctacaggcccctgtgtaacctgggtcctctgttcctttctgatccgtcttgtatcactcttccccttgctcactatgcttcaaccaaaatgactttctgctctccaaatataccaagctcattcccacttcagaacctttgcaattattgttttctctgaatggaaagtctggttctttcttatccttcaggtcttggctcaaatgtcaccttctcagagagtcctcagaccactccatctgcacagtagttcctgagtcagtcactatacatcaccctgtttatttacatcataatgttaacctcactgtctgaaatactcttattggtttgcttgtatattttctgtcttccctattcaaatgaaagttgcctgaggacagagactttttctgctttgtttactagtgtctctagagcctagaagagtacctggcacacagtaggcactcaataaatgtttgctgaattaatggatgaatatataagagaatatgaatggggccacatacgatcctcacttctgacctggagtctgcagctagaggagaggtgtttagctttaaaagaaaaaagttggccgggcacggtggctcacacctgtaatcccagcactttgggaggctgaggcaggcagatcacgaggtcaagagatcgagaccatcctagccaacatggtgaaaccccgtctctactaaaaatacaaaaaaattagctgggcgtggtggcgcaggcctgtagtcccaggtactctggaggctgaggcgggagaatcgcttgaacccaggaagcagaagttgcagtgagccaagattgtgccactgcactccagcctggcgacagagcgaggctccgtctcaaattaataataataataaaagaaaaatgtttaagtacagttggcaatagctctggcatgagttgtcaggcactagaactctgtaacagcctcagaataagaagtctctagtgactgtgtgccatttggagtctgatttcatcaacccagagtctcttgacagagtctcaggaatacaggtgagggagcacttcccagactgctgtggccattagcccatcttcgtaggaaactgttatggggtggctaatcttgctgtacaacccatcttccctggtgggctgagagtggggcccctctttagcctcttctggtgtttctcctcagggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtcaa

SEQ ID NO: 4780 - DNA, 57031 bp, human; identical to SEQ ID NO: 4778

SEQ ID NO: 4781 - DNA, 57031 bp, human; identical to SEQ ID NO: 4778

SEQ ID NO: 4782 - DNA, 56214 bp, human
gagggtgagaagggccggctgccggagctgggttgcgatcttcccggagccggagaccctcccttgaaaccggcactgggacttctcgatctctggaggcacctgttgcaagtgacaggtaggtcaacagccagcggccggcccctcgccctcggtccggtgctccttctggacccccagctccttttcgctgctgaagcgcccccacccccatctcggggtcgtgcgtcttccctacccgctctctggtcccccaatttttccttctccctagctgaccgcgtctcccctctccccgtccgcctctcccgaccgcatccccaggcttggactcccgtctgcttgggcggtccctcccggccacttttctttctccagggcttcttctggccccttccctgacccacccagcactaatgcggtctgtgcccctctgggagccgcctcccctctcctcttcggctcccctcgcggggagtgcccgggcttttcccgccagcccgagctggtgcccctcccgagagctggccctgggggcgggggcggggccgagctcctagcgggaactgcgccctccaaggcgtccagtcaccttttcgtgggttcctctcacagcgctcggccgtcgagcggggtcgctaacccgcactctcttcggacctacgacatcgcggcttctctggcgttggccagtcagccacaggtaaaggctggaggctggttggctggagtcctgcctcagtgggctccctctgcgcttggggctggggacctggctgtgtgctgtggagctgctttatattgccgctcttcaagcaggctgtgagagatctggtactggaggagggtccccgagatctcagaaggggcacagaatgcttctgtctcctgtgttggtttgtaatggggcagaaaaaggtgttcctccaacccttaacattgaatgaggtgggatttggggtggtgaaatcatttggttagaattctggtggcttgaaaagtggtgactttctaatcaagcttttcttcccccagtaccctgcttcttcaggattagaggacgtaaaattccagagtactgtgcttggcagggttgaccctagaccttgtatatttgtggcaaaaatgagtcttctgtacatcctggacctcctatatttaactggcttattttctgctctttaagctccccacccccacctctcataaatctattaatattgaggtattaatgacttaagacttttgtcgctgtgggaacaatgtttaatgcagagacgtggccttgatgaagttttctgcgtttttggttgtttggtttttagcaccctagtagaaaagcaccaccaacttggcttgtgaggccctttttgggcagaggatgaacatttctggtaacacaatttcaggtgtctcactcttggtcagagcagtgaaatggagctggaggcctgttctggggtaattgatctgtgagtatatgtagcattctggctctctgagcttgttaggctctggttgttaggctccattgagctggacactgtgataagttctttacataaaaatgcaatcctcacaataactctatacagtaggtgctacagttataaccatattatgatgaaaaagagactgagaagttaagtgccttgccctcaaaatctcggaggcagagcttgtgttcctatcctgtcacaccacctctgttgtcttagatgttgggaacactgaatagctcatggatgaggactaagtgattaaaaaattgtcttccaagcccaagtatatgtttttctccttgcttccaccttagatgcactgccgagactatggactacttaccttactgatgtcttacccacttcatttccaacatgggccagttgccacgttaccactataagtacacatccctgagtgtaattagatgaatgaaatctcccgggttttcagctctgtggtaattgtcctgaagttaggggagggtaaccctggattctagggatgtgtgcctgactcaacttcttcctctcctgctggctaggggagaaatgagggagtggtaagtgatatggatttcctgacagccataccagagagcctgagggtgatcgtgtgctagttttgtcatgggatggatggagtaccatagacaaggataggaagaaaatgtcctccctattcccatctctgggactttgctcaaactgttcctttttttcttcctaaaaagctaactttcctccctcattccccctcccctgacattaattcctatccatccctcaagattgagttctaaagtcacctcctttggaacggccttactgaacacatacttcttcccccaagcagaattgccagttatcctgtgtcctaaagcactttgtttacacctcagtaaagcccttaacactgcttagttgtttttccacctggaaggctgtaagttctctaagggcaaggtctggatctcggagctccctttgtcttaaatataagatgttggcaaatatttgtgccagtaaccggacataccatgccattccttcaaggggctgaggtgtagtgatggtggggttgaggtacagaagacaccttcctgaggcacttgaaataccacagctaggaatttgccctgaccaccctatttaaacgtgtaatcccttccctgaacattccatatgccctttccctaccttattacattgttcttgcttattgtctgccctcccactccctcacccaccataacataaacaccctgtgggcagggattgctgtctgttgtattcaccagtagactcttggacccagaacagtccttggtacatcataggtgcatactaatatttgttaatgaattaatggcattgccattctaggaatttggcactcttggagttaggcactcctggacctgaaactaagcctacccagtttgtcgccctacaggtgtaagtttgccccaggcccaaaactcagctttacttctgctgatttttgctttgagattgcattcctgatgccaactttgacctagttggaagtacttcctctctcttacttttttttttttttgaggcagagtttcgctgtgtcgcccaggctagagtacagtggcgcgatcttggctcactgcaagctctgcctcctgggttcatgccattctcctgcctcagccttctgagtagctggaactacaggcgcccgccaccatgcccggctaactttttgtgtttttagtagagacgggatttcaccgtgttagccaggatggtctcgatcttctgacctcgtgatctgccctcctcggcctcccaaagtgctgggattacaggcgtgagccaccgctcctggcctctctattttttaaaagtatgagtctctgggtggaaatctctaaagtttaaaagtggaaatgtaaaaatgttgtgcttcttgttggtaggaagggggactgcactgggaggaaggggtgtggattgtcagatgtcttgaggcttttcaggcttctcgcaagatcaataagaggctggagaaagttactgtgcaatggggaagtgaacagctcaaaagaataacggatggcacaaattaggcttctggtttcaagttacccatagccttttaggtatgaggtggttattggattatggaactttatggaaaagccgtagctgagtgctatttgtgttgtacttaactagttttctaccaggatgactgtgcagtctggagaaaccactgtgtaacataaaagaaaaaagtgctattctgtttaaaagtgttttgaaatgttcagaaaggaagaggccagaatctcttagaagacagacttggaaggagttgggcccttcaaaaggtggtaaatatgtgattctcatcatttaatatatgttaacttatttgaaactcaaatttgtacaaaaagctgaccagcttctttttctactaaatttgtctccccagcctttgaacattgcagtgacctggggttcagtccctggacttttctccatctaaaatcttcacagaggctctcatccagctgcatggctttgaagaacatctgtctagactgttgtcactcccaaatttatgtttgttacccaggcctttcttctaagctgcagcctcatatatccaatgacctatttgacatctctgcttgcctatcagatagacctctcaaatgtaacgtggccaaaacggcactcccgattgcccttgtattcccaccctcttccctcagcactccctgtctcagtaaaatgtcaccatcatccattcagttgctcaaaccaagaacctaagatcacccttgattcttctttttctatcactgctctccacccaatttaattcatgagggagtcctgctgacctgatcttcagactgtatcatgtgttctgccacacgtctccatctcctctgcctgtcaccctagtccaagccaccacacgtctgccacaaacattcttgcataatgctcaaggatatatatatacacaagtatttttgtgggatagctttctaataggagaattgttaggtcaaaggacatatacattaaacaatttaaataggcatcaccagagtgacatctaagagggtttaccctttcaccattgcgagtggttttcctcctgcccttgctgaggatggatgacgcttttaattttttccaatctgataggtgaaaaatagtatctaactgatttaacttggcatttctctgatcactagtgtggctgagcatcttttcatttgtgctagctatttgtatttttccaagacttgctcctttatatcctttgcacatttatcttttgggttatatatttgatttgtttgtaagaacactatatttattagttatatttacccattgcctattatatagtgcaagtttttttctctctagtctgtcatatgtcataactttgttcatgatgtgtacccctctcgtaatcagataaaacccactataaaacatttaaaaaacacgttcattagatttggcaattaggaggccaatgacaacatcagtgcagcaggaggagagaaggcagatcgtagagggttgggcagtgaggactgagaaggactgataaaaaatatggtagatacacatggacatggagagtgggatgatagacaatggagactcagaagggtgaggggtgggagaagggtagatgatgagaaatttcttaatgggtacaatgtatgttattcaggttatagataccctaaagtctctgacttaaccactgcatatgtaacaaaattgcatgtgtaccccataaatttatataattaaaaacatgtagtatatacattgaagaagcttggctatgatgggaaggagagagtgttccttatagacagtaaggcacaggggataaaaaggctgttttatttaattttgttttactttaaatataagagatagatgagcccatttatgtgcagatggcatacagcttgatgatgcaaggtccccgagaaagtcagagggtgggagtgccagagtgaaagaggagaaaagactagccttagagaaaaagtggtggctcttccattgaaacaagaggattcaccaatcctcttggtaaaaactatggagaaggaagtacctgtggagggacaggattttgagagagcccctccgcccccaacaagagagtgaaaggttcaccagagagtaaagaaggcaagaatggtgaagggttggaatagcatttgagagagacgaaaagaggagttctttaggggcatatcatccaggttatgtatgtgtatttcaaaatatcatgctgtacaccataaatagacacaatttttgtcaagtatacctccataaaactggaaaaaagttttaaaatggcttgggtaacttgaatttgtctctgcctcaagtcgcagaaccctgtatccattctgtctggcagcactcatcagaccaggaacagagtgtggacaatctagtatggggaattttttccgggtggccgtgacagaaatagggagagggctggagattggatggccctggcagaagaatagttgaaatgatggaccactgtggctttcatattcatatctgtgactatctaaacctaacttgaccttgagtaatttttaagaagtagaaaatttccatggcatctacactgcttcttgtttgtagctctatcgattcaggcatcagaataccattagtatcagtgtctttaaactcatcagaaagcgtgatttgatttactgagggcctatgttgtgccatgctctgtgttgatttactgaggatttacgttgcaccaactgagagcctacagtcaggatcctacaatgtagatttatccatctatccatccatcaacccagctagatgcttgaggtatggctgagaagaaggtagacaatggccatttttctcctggaacttatttcggcaggggaagtgtatattaaatattgtatcacataattttttaattacaattgtgataagttctgtgaagttcagttttcttagaaatcagattgtcacattgctttttaacaggccttactaatttacatttgccaacaaaatatgagaatatctcttaaatcctttttaaaaactgaaaattgtctttctgaaattttgctgaattaataagcaaacataaaaaaatctttattgccagtaagagtgaaactttttctttttgatgtgtattggccatgtgatttttcccctttaagaattatctattcacgctctctgtctattggatacttacctcttcttgtttttaatagatctctcattccatgtttgaaaccattagctacacttctctcctttctctcttagccctggtgaccttaaaatattttcccctagtctctacggccattcccttttgatctcctgtgaaatttttttcttacctagaagtgttgctgtgcttagggatgggactacatttttattacttgactcaataaaaggtaacatataaatcttctgttcctgcttatcccactctccagaggtaacaatgttaagattgtatttctttctagacatttttccattcatccatgatccaatctgtctaaaatgtaaacaaataaaaatggaatcataatatatatgatttgcaatttttttaatttaatatgctttcagtgtcagtatatatagaactacagtaccttcttctttttttttttttcttttttcttttttttttttattgatcattcttgggtgtttctcgcagagggggatttggcagggtcacaggacaatagtggagggaaggtcagcagataaacaagtgaacagaggcctctggttttcctaggccagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacatggcaaccatccgatttctcaatcttttccccacctttcccccctttctattccacaaaaccaccattgtcatcatggcccgttctcaatgagctgttgggtacacctcccagacggggtggtggccgggcagaggggctcctcacttcccagtaggggcggccgggcagaggcgcccctcacctcccggatggggcggctggccgggcggggcgctgaccccccccacctccctcctggacggggcggctggccgggcgggggagctgatgacccccccacctccctcccggacggggcggctggccgtgtggggggctgaccccccccacctccctcccggacggggcggctggccgggcagaggggctcctcacttcccagcaggggcggccgggcagaggcgcccctcacctcccggaacgggcggctggctgggcggggggctgaccccccccacctccctcccggacggggcggctggccgggcggggggctgacccccccacctccctccctgacggggcggctggcctggcgggggctgaccccccacctccctcccggacagggtggctggcctggcgggggctgacccccacctccctcccggacggggtggctgccaggcggagacgctcctcacttcccagacggggtggctgccgggcggagggactcctcacttctcagacggtgcggctgccgggcggaggggctcctcacttctcagacggggcggccgggcagagacgctcctcacatcccagacggggcggcagggcagaggcgctccccacatctcagacgatgggcggccgggcagagacgctcctcactgcctagatgggatggcggccgggatgaggcgctcctcacttcctagatgggatggcggccaggcagagacactcctcacttcccagatggggtggcggccgggcagaggctgcaatctcggcactttgggaggccaagggaggcggctgggaggtggaggttgtagtgagccgagatcacgctactgcactccagcctgggcactattgagcactgagtgaacgacactccgtctgcaatcccagcacctcgggaagccaaggctggcggatcactcgtggttaggagctggagaccagcctggccaacacagcgaaatcccatctccaccaaaaaaatacgaaaaccagtcaggcgtggcggcgcgcgcctgcgatcgcaggcactcggcaggctgaggcaggagaatcaggcagggaggttgcagtgagccgagatggcagcagtacagtccagcttcacctctgcatcagagggagaccgtaccttcttctttttaacaaaggcacaatattccctaatatgtgtgtacaataactagtcagtttcctttgatggatgtttatgttctttaatttttttttttttgctgtttcaaatattgagcatcctcagaatatatatttgtgaatttacttgaatatcagcagaataagtttctcaaaatgaaatggctatgttaaaaatatggtcagtggtactaaagatccagagaaatctaggaagaccaagaactgtctattggatttaggaagttcttggtgaccttagagcaatttcagagaactgtgaggcagaaagctaaactatggtgggttgagaaatgattggagagatgaggaagtgaaggcagtgattatgtacaattccttagagaaatctgtctggctttgaagagcagagaaagggtagtagcaaggaaggagttgagattgaggacctgttatttatttatttatttatttatttaggaaggacttgagtttctttaaaggctggtgggaaggagggactaattaatagagcaaaatccttggaaggcaaagtccttatgccagatgggaggggatccagattgaggtagaggattatcctcaataggcatagatgaaagtaggttcatagatttggcggcaggaacttgtctgatggtatttctatttctctatgatataatagttaaggccaacctcttagagcaggggttaagatgggacaaggtttgagttagatatttgtggtatttgaagaaggtttgaaatagttattgtggagaacaggagagcagcctagggaagcatagttgcagtgccaggcagggttaagatgagcttggtgaccaagaattcatatggataataatctaccagagtgtgattttttttttctccagtagatctcaggagtccttgtgcatgcataaagtataacagttgggcttagaagagctatggttttttaaatcagatatttgcagtgaaattatgcattattgaggatattgacaagagtgcagttgaaacaatagaattggctgggtgcggtggctcacaccagtaatcccagcactttgggaggctgaggcgggtggatcacctgaggttaggagctcgagaccagtctggccaacatggtgaaaccccatctctactaaaaatacaaaaattagccgggcatggtggcgcacacctgtaatcccagctacttgggaggctgaggcaggagaatcgcttgaatccaggaggcagtggttgcagtgagccaagatcatgccactgcactccagccagagcaatagagaaaaagtctcagaaaaaaaaaagagaaagaaacaataaaatttaaatgttattgggaaggaagtaaagatgggaaggagctgaggaggtgaaagcagaagggtctatggaagactgcccccatccaagaaatctgagaacaggaatggggctagttggggggctcattggctgaataggctagaagcacagcaggttgtggtcagagagggggtgttgaatcagtgatatcaaaggtggagaagtcctagatgataagctcttgggtgtggctgaatatgatatatggtattcttgatgccagctcattcattcaacaaatatttattttgtgcatattatgatccaggcagtgctctaggcaccaaaggtacagaaatgaacaaaacaaagtcccttctgtcatacagcttacaatctagtgggggagattatttttataaactaaaagaacatccttattgatgtgctgattcctgtatgtgtagctttatttgtaactaatgataataccaggatcaaatatttacatatatgggggctaagaaggtccatctaggcattttgagtatcttgctttatctcaagttatacttactgaattatgaaaactcatacctcttttccccttagaactttttaaggtatttttacttactatgtcagtattgaaaataaacaaatatatacaaatctaatttgaatatttcattggttttaattttttatactgtattttttaaaaatattaggatattgcttcaagctgtagaccagatgttgataatgcatgtactaatcttgctctagggatttgatgtaatgtgtaaagtaattatggttaagcagtttaggagggaaagagggcttgtaataagttaatattttatgtttatttttatattattctccaatttattttattatttatacctaccttttaatgtacatatggtcatgtatatatttattaatattttatttgaaagaaataagcatttatttggcatcttataggcctcaagtaacactttaaaattacctgccacgtatgcaattcaatttaaattcaactacaggttattttttattgttttaaggtttctgtggccatagccagatcacagcatccctaaaattaaaaagaaaccaaatgcatgaaatcacagttatgtgtgagcatgggctggattagtcatgaaccatgatgatttcacatttaaggggactgtgtgggtaatttttaggtgacatggtctgcaagaaataatcagatgccagttagagttcagtttagaaatccccaccatctgtgatcccagcaggagaagagggtcttccctgcgggagtgctgcattatcaaagcttgttgactaaggaaagataatagtgttctgcgtgggaggtgatgaggcttattgaaaaataacaatgtgtcagctctcactggacttaaaaatgttttgtacatataaatgacctagattttaaaacagtccattcttttagttggggattttagattttttaaaaatctaaaaaatggggctgtcaaggaaggggcttttggcagagaagagggtaaactggccatcctgcacccatcagcctatgaggctcttgtgtctggctcatgttagaggaagcttcaaatgtagattttgaaagctggaaagctaaatgggatttgttttaatatatgtattttccctgttgccaagtagggtgtttggacacatggtctttataatattttagagttacttctatgtatcacatttatggaaatctgccttctaggattggtggtgggtttaaggcaccttctagagttgctgaggagcaggggacaaacgtgtagaatcatgaaggaccacatttccacatatccaaaacaaccattctgcaggagaaatgaatatatagtattaagatatctgacttccttctgggacttgttttagagttgtatatattattttaagtgggaatttctacaaaccatttatgaacagaatttgttggtattgaaaggtagctatgtggattccatctggaggaaattgtccccacatatgattctaaaagctaacaaaagaggcattttagttactaccactgccttcttccaccctgctgcccacccccaccccctgccccaccattatgcacctgccatcttttaggatggatgtcctggatgaggggaatgagttattgtcttgcgtataatgttgctttgagctagagttgctctggcgtgttacacatattgcaggaggaggtcaggggtctgggaaagtaagccagactgagggcctctcaaacattgtgtttgttattagctgaagacttttagaaaccccacctcaagttcctgaggttgatgttcccttttccaaaaatcaccatatagagcaatattgccagaatatgaagagacagtataatgtaatgtaacggttaagagcttggactctggaaccagacggcctgggtccaaaaaccagactgtcacagggcatgtgaccttgagcaagttatttgctcaatctgtgcctcactttcctcatttgtaaagtggacataataatttagtacctacctcatagtgtgattgtgaggactaaataaagtgcttagaagagtgcatggtacataataaacattatagaagtgttaactatcattgtcatcatcttcatcagttggtggatatcttaaaaggagtgaaaaccggccaggtgagatggctaatgcctgtaatcccagcacgttgggaggccgagatgggcagatcacgaggtcaggcatttgagaccagcctggccaacatggtgaaaccctgtctctactaaaaatacaaaaattagccgggtgtgatggcacacacctgtaatcccagctactgggaggctgaggcaggagaatcccttgaacccaggaggcggaggttgaggtgagctgagatggcgctgcctaactccagcctgggcaacagagtgagactccatctcacaaaaaaaaaaaaaaaaggagtgaaaagcacaaaatgcctcagcacatgcaaactctacttttgtagaatctattttgaaaaggatcgtagggagccaaaaccttactgcaaaatcagaattttgtaaaattaagagctagttgtaaatttctcattgttagggaaaaatacagctttgctcccatacaacttttgagaatggatttgtgaaggcaggccctaggggattttatgtgaggcatagatgtgctccatggatggacaggtgagggtctagaccccagctgactcctaggaagcctcagttgccctttggttttggagccttgatactgactctaccagtttgtctccactcctatttttcttctttttgatcctatttttaaaatttatgatattttttgatgttttatgaatctttgtaagtcactttaaatcctgtctggaacagtgtataaataaatatcctttaaactgatcatatctaattactaacatttgcttcatatttatgcttgtcagcctccctccatgcagagaggtacggtgaccttccatctaggcaagaatactgattagatttctcaaatttcatagaaagatgtcaaaactgccatatgctcatatattttccaaagcatatggttaataataattaaaactaaacagctaccaatattgggtgcttactctaggccaggcactatgctatgccttttactcatgatgcatgcttgaatcctcaaagccataggcaggagctcttattattaatcctcatttttacaaatggggaaacagactcaaggaggttaaataacttgcccaaagttaattcagggaaaaagcaaagctgtgattttaacccaggcagctcagatccagtgcttttaagcacaattctatgctatactgtccttaattagaaatctagcacatcagaactccaagtcctagtataagaggccgtacttgtgttacagaacattcacaggtcctgcagattttctctccgtgtaatgtctttaatatgcccctttccatctctagtgccactgccctctactcttggctcttgttatctttcccctggatttatgccacagcctcctcaaatccatagtctgcaaaattgtcagtgtgccctaacaagtccttgctttacataaaactcttcaatgatttctgttgtcaaaggctaattagccgtgtttttgcgcgtagcatatggagcacccgccagccacacatgatgtgattccccacctgcctcttccgcattctcccttacaatttaaaccaaccagcatcattgtattacttgctcataccacgttgctttatgcctccatgcttttgtaagtgctacgcactttgcctggaaagccctcgttctcctgcttatccagctgaaaaacattaatttacaatcagttcatgtgctactgctggatattctctttctagttccctttccccaagctgaattatgtgccctcccttggtattcttataatatctcatgcatatatttctttggttaccatgttttttttttaggattatttaagtgtctctgttactaaactgtgaactctgtgggcatggactagctctgttcttttcttcttagccagctagtgtaccgcttagcacatagttggccctcctaactagtgagcattctgtaacagtgcagaatacagagctctaggacagggaaagaagtaagatttggaaggcctgaaactgtgcacacattcaaagataattaccaggacagcagaaggagctcttgcagaaaaatctttggggccaggtaatttacattatttaacccaagagccagaaaggatgtggggagatgggagctggggtctgaatccaaagggaactttgaaacttctaagaagccagacttagcagctttataaattgaaacttccttgaatttgtctgagtagcctggaataggtatctaagacagttacattttaataagaatatttatagttttctaggagagacatcaccctaaaattgaaaggggcagttgatacaataaccaacacaatatcccaaagcaattattttattgactgtaagcaatgttgtatgctcatgcaaatgttaccagtaagatgttatccattggtatttttgtgcataggtggctggatccagacaaggggattttaggaagccctgcatccctggaagctttcttttctacttgagtttttttcttttttttttttttttttttaagttttgcagaccaccatatactctggatttggtttcatttttccgtgctctaaaatcaacttttttttttttttttttgagatggagttttgctcttgttgcccaggctggagtgcagtggtgtgatctcagctcaccgcaacctctgcctctcaggttcacgtgattcttctgcctcagccttcccgagtagctgggattacaggcatgcaccaccatgccagggtaattttgtatttttagtagagacggagtttctccgtgttggtcaggctggtcttgaactcccaacctcaggtgatccgcccgcctcggcctcccaaagtgctgagattacagacgtgagccaccgctcccggccaaatcaactcttttacctttagattatcaaataactagtcccccgcccatcggtactagattttgctaccttttagggctatgcttcacccatgttctggaaacccacacaaataatacgtattagttttgacagtactttagcttgatctgctttagatgctgtcattgcctttgtcacaattagttaatagagtccactttttttttttttttttttttgagagagagagaaaaggtcttattctgtcacccaggctggagtgcagtggcccaatcttggctcactgtagccttgacctcccgggctcaggtgatcctcccacctcagccttccaagtagctgggattacaggcacataccaccacacctggctaatttgtgtgtgtgtctgtgtctgtgtgtgtgtagagagatggggtttcaccgtgtagtccaggctggtctcaaactcctgggctcaagagatcctcccacctcggcttcacaaattgctaggatgagccacctcacctagcctagagtccacttttgaatgtgtcttatgacagcaaaaattcttattcattatgctgtactacttgcataagagcaactgcattacaatcatcagaatgatttattctttcctaattaacatacatcatatctctatgcaagtagaatcatgaaaatatatggcaatttgtagaatagtttcccttaaccagcctttaagtaaaggacttcctagcttttttgattactcacctttatcaccccaaatttttatcactcctaaaataagtatttataaactacattatttaccactgtattggtcatatattataaagcatgcacaggccaggtgtggtgtctcatgcctgtaatcccagccctttgggaggccgaggcaggaggatcacttgagtctaagagttcgagaccagcctgggaaacatggtgaaaccccatctctacaaaaaataaaaacaaagtagccaggtgtggtggcttgtgcctgcaatcccagctactggggaggctgaggtgggagaattgcttgagtccaggaggtcaaggctacactgagctacgattgtgccgctgcactccagcttgggtgacagagtgagactctgtctcaaagaaaaagcacaaaaatggaaataaagaaggatgagagattaaatgaacttttaaaaaataattctaatatttattaatggtacaataacctttgctctcattttgatgaggccagtgacattaaatgtgcttcatttaaacaaaattttggtttatgatacagctacttgaacatctgattctaacttctgtttatttttatacttgattttaatgactgatgcctcacaaagtatatacattttaaaataaaagaagtatattgtttggatgcacttactaaataatcatactcatattacagttccaggcaccagttatgcaaacattttattgctgttcctgaacctgctgtcttttatgtttttgacaaattgaaaagttaaaacgtgaaacatcttttagataacaaaactgtgtagtaagggaaatatttcaaacctactctgtattgtttattctctattaaaaaaccttggccaggcacggtggctcacgcctgtaatccccgcactttgggaggctgaggtgggcagatcacgaggtcaggagatcgagaccatcctggctaacacggtgaaaccctgtctctactagaaatacaaaaaattagccgggtgtggtggcgggtgcctgtagtcccagctactcgggaggctgaggcaggagaatggcgtgaacccaggaggcggagcttgcagtgagccaagatcgtgccactgcactccagcctgggcaacagcaagactccatctcaaaaaaaaaaaaaaatcttgacataaaatattttagtgtttcaattaatttaaaggctcctagtgtcttgtaggtattctgggattggaaaacatgattacaagaagaaagtttagttacatttaatattaaaatgtttaaaaacattttattgaactacaatagacaaattatatataaagtatacaatttgacaaattttgacatctgtatatatccatgaaactatcaccagaattaagatattgaacatctatcacctccaaaagtttccttgtgccatgttgtaatccttccttcttgtccctgtgtgctattaccctccttacccccgtcaactcctgaaaccactgattctgttttctgacactatgtattttctagaattttatataaatgaaatcatacagtgttttttttttgcctgacttatttcagtcagcataattattttgagattcgttcatgttgctatgtgtatcagtagttcattcttctctattgctaagtagtattccattgcatgggtatactacaatttgtttatccatttacctcttagtaggcatttgggctgtttccagatttgggctattaccaataatgctgttaacatttccatgcaaatctgtgtaggcatatgctttttttttttcccccttttgaggcaaagtctcactctgttgcccaggctggagtgcagtggcgcaatcttggctcactgcaacctccacctcccaggttcaagcgattctcccacctcagcctcccaagtaactgggattacaggcatgcaccaccacacccagctaagttttgtttttgttttcttttgagacggagtttccctcttgttgcccaggctggagtatagtggcacgatctcagctcactgcaaccaccacctccctggttcaagctattctcctgcctcagcctcccaagtagctgggattacaggtgcctgccaccacacctgggtaattttttgtatttttagtagagacggggtttcaccatgttgatcggctggcttcaaattcctgacctcaagcgatccgcccaccttggcctcccaaagtgctgggattgtgggtgtgagccaccacgtccggcctacgtatgcttttgcttttcttggataaataccaaaagtggaaagcctgggtcatatgggagatatatgtttaactttttaagaaactgctaagctgttttccaatatggctataccatttcacattcccactgtagtgtatgagagttccagttgcttcaaatgccggccaacatttggtgcattttaaattttggtcattctaataagtatgtagtgatatctcattgtggttttagtttgcatttccctaatgattaatgatgttgatcatgttttcatgtgtttatttgctatttgtatatcttctttggtgatatgtttattcatatcttttgtctattcatatcattgtctattttttaaatttgtgtttttaaaaatattgtagagttctgagagttctttatatatgctggatataagtccttatcagatatactagttgcaaatattttcttccagtatactgcttatctttttattttctaataaagttcttacaaagcagaggttttaaattttgatgaagcctaatttatcaagttctggatcacgttttacgtgtcatgtcagaaatgcttgctttttttgtttcatatggatatctagtttttccagcactacttgttgaaaagactgccatttctccactaaacttcccttaacctttatttaaaaaatcaagtgactataaacatgagggcttatttccatactctctattctgttcgtttatttgtctgtcttcctgcccagtaccacattgacttgattactgtggatttatagtgtctcttaaaatcaggttaagtttccgctttgttctaccatatgttttgaacctcacaatatatcgttatttttcctttaaacggtcgattatattttaaaagagatttaaataataagaaaaaagtatttttacctacattgttaccattgcatgtgctctgtatccctttttgtaaacctatatttctgtgcagtaccattttctttctgcttcaaggacttcctttaacactttttatagtgcaggtctgctggtgattaattctttcaacttttgcatgtctgaaaaagtctttatttcacctctgtttttgaatgatatcttgctgggtgtagaattctatctaggttgatggttgttttttttctttcagtattttagagaggttgttctgtctttacacttgcattgattccaatgataaatttgcttttatcattatctttgttcatctgtatatatataatgtgtccttccccaagaccccaaccccaccccaccccaccactctagcttcttttaagattttcccattgtttctggttttaagcaatttatggtgtgccacatggtatatttttctttatgtttctggtgctttatgttcatagagcttcttggatctgtgagtttatagtgttcaccaaatttgggccattatttttggtgacatcaatgacatgtatagaaggtagcttgatgttgtcccatagctcattaattcctttttctttttttcagttttttctgtgttccattttgaataatttctattgctatgtcttcaagttcttaactcttttctactgtaatgtccaatttgctgttaatcccaacgagtgtgtttttcatctcagacattgtaccttttatccataggtttgatttgagtctttttacatctcccatgtcccctgcctagctttttgaacatatagaatgcagttataataactgctttgatgactttgtttactaattctaacatttgtgtcagttcttggtctttttgattgatttttctcattattatggatcatattttcttgcttttttgcatgcctgttagttttttactgggtaccaaatattatgaatttgaccttgttgagtactgcatatttttgtattactataagtatacttgctctctgttctgggatgcccttaaattacttggatacagagtgaccctttcaggttttgctgtttagatttgttaggcaggaccagagcagtgcataatctgggctatttcccactactgaggcaagacccttctgagtccttcagctagtgtcccgtgaatcatgacgttttccaatttggctggcggaaacaggcactattcttagccctgtgtgagtgacaggcattgttcttttgaatcctttcaggtagttctttccctggcctagagtaatttcctcacaggcataccatgggctaatcagtcctttgctaaacacttgagtgaaaccttctgcaggcctctgaagatctctttctctttctgtggagctctctcaggtcctctgtcctatgaactccagctacctggtttttttcccagactctcagctctgtctccagaactcagggagttcactaggctctacctgggttcttcctttctgtaccattatctggaaattctcttaagacagtaagctgggaaaatcaaagggctcaccttatgtgttttccatctcagaaatcataatccttcattgcctgatgttcagtgatttgaaaaccattgtttcatgtatttggtacatttgttgttgttgttattgtttcaggcagggtggaaattcattccaccttgacattttataatctccaattatgaccaattaaaatttgtagcccaatttaaattctcatctttcgaaaaaagtgtagacaccatcacatttcttgacgtagctaaatcagttctgaatacccatgttcaaaagtatacagaatctggcatgcagcagtataaatctcacatcagtataaaactcattgatcagtttcggtgtaaaacatagtatcattttaaaaagagcagtttaattcaggcttcttggttaaatgaatatattttgaaagactctggttcactttttcatgttcagtgaggtattgtccattgtccttagcctaaacagcaaaatacttttattacatcactttggcaggatatgataatccattagaatgtatttgcaaaaccatcatataattactacttataactttagagaataatttaatatcagttcagccttttggcccttgagcatgggtcaatttttaagaaaatcttctgtcatctataaggctgtcagcatggttcctcacttcaaaaacagtggcctgtgattaatgcattaaaattaatcactataaattcatccatgtacccaaaaactacttgtaccccaaaagctattgaaataaaaaaatttaaagaacaataacaatagcctgaaactttaactgacgtctagacagtttaactcacaattcatctgcattctttaaaagaaaataaatgtcattttctaagacctagttaagtccgaaagcacaaatgaacatatacaaactgacaaaaataggtaacacttagcattctttgtgttctcattactttaagcactttacgtattttaaaaactcatttaatctttataaaaacaagccccaaaggataggtacaatttttatcttcattttgcaagtgaggaaattgaggtactgagaggattagtaacttacccaaggtcacacagctagtaaatgtggaagttgggattcaagttcaggcagtctggctcaattccaagctttttgtttgtttgttttatggacacagagtctcactctgtcgcccaggctggagtgcagttgcaccatcttggctcactgcaacttccgcctcccaggttcgagccattctctgcctcagcgtcctgagtatctgggactacaggcgcaagccaccatgcctggctaatttttttttttttttgtattttttgtagagacagggtttcaccatgttggccaggctggcctcaaactcctggcctcaagtgatccacccgccttagcctcccaaaatgctgggattgcaggtgtgagccacccacctggcccagagtccaagcttttaaccacagctcacacactgcctcaggaaaacaaaaacatttttctctcagctctattacagctcttcaatttccatgggtttaagtttaaacatgtaaacacagatagatttctgggtaaagacattcactagacttttgttgaactcatactgtgtgtcacacactgtgccaagctcctggggctatgatatccagatatagtacctaccttcaaagaggttacgtctggtagatgtttctagtttgagcataagtaccatatattaccatcttcacttttatgtgtggcctgcatgcaacacagcaaaatctgttgtatttgctgtccagggcagggacattacttgtgtcttcctaattcacatcagttttcattttgggaacaccaatgattacttttaatctgagtactattcttacaaggaattctatattttagtcatctttttaatattctagtctcatgcccaaggtcatatagctaaaaatagcagagctaggatttgaacccaagtctgtctttcaccactattttcattattctatgcttcctgtcaagttttgcctagcttttcatttttaaaattggtctttagaatttgaaataatttgagatagctcacccatccccttcttgaaaaccagttgtgttagtgtttattttcattcattgttattatttctcaatcattaggattaggatatagactggatatatctagttggatatggaattctacatatgtcctttagatcaagcttattgtgttgttcaccttgtctacatatttactaatttttcatctgttatactatcagtaattgagagaggtatggtaacttcccatttttatggtagatttagtttttcctttggttttgtaagtatttgcattaacatattatcctcattttttagtagtaaatatgtataattgctaagtaagccatcttttcttttttttaattttttttattatactttaagttctgggataccagaatgtgcaggtttgttacataggtatacacgtgccatggtggtttcctgcacccatcaacccgtcatctacattaggtatttctcctaatgctatccctcccctagccccccacccccgacaggccccggtgtatgatgttcccctccctgtgtccatgtgttctcgttgttcaactcccgcttatgagagaacatgcggtgtttggttttctgttcttgtgatagtttgctgagaatgatacaaaccaccttttctaaaatatatttttatgggcatgggtcccacaaggatgctatattaagatacttcatctgagtcttgacacctcaggactaacacagaacaagttgtccatctgagctcagattctgacactcatgttacctgagccgtggtcttctcaatagataatcttgcctttttgactgtacacctgggactgaatgtaatgaagggtcttaagttttcttgggctttggtttctctattaaaccctagtagccataaattgggagtatccgattagtcatagcttttctaacttcacatctatctggttttcttattataactgtatttgtgcctccattattttcctgagttctagttttcaaaatatgatgtactatttaccataaaaatatatcacttggtttattgcatatgaaagctgtatttttctttcatattttcctttttgaatttctagagaacattctatgccatagtatggggagtagtgatggtagtgaggtaggaggcaggtattttcctctaagatgttaaggatagatttagtaccattatgatctcttctttgacatgtgggttatttagaagtgtctttataaattttaaaaaaaagtattgtgataagaaattaccttattttaaattgatttcttatttaatttaatttcctcgaagtcagagactggtctgtatgggaaggattttttaaaaaaattatgcagacttgcattacagcctagtacatggtcagttttgggagtaaatattctatatgtgcttgaaaataatgtaattctccagttggatatagattttttttgtattcctattaaatcaagctcattttgttgttcaacttgtctatatatttactagtttgtatctgcttgtaccattcataattgcaacaacaaagaagtatatgttaacctctcattttgatggttgatttttcaatttctctcttttgttcctttgtatatttagtgatgttttattagtgggtgcatatttattatctctatgtagtgatcttatctaacctttataaagcttttattgtcttttttacttttagatattaatatagctacctcagctttcttttggctagcatttacctggtatatcttttcctatctttttactttcaattttcccttcaatttatgttttagatgtgtctctcataaatggcacataactggattttttccttttatccagtctgttaattcctgtatttcaaagggtgaattttgctcatatatgagtttcatattcattgatatacttgaacttgtttttaccattttaccttttgttttctctttgtctcagttttttctgcacttacctttgtcttcttgccttttaatttttgttcttaatttgttttctgctcctcattactgattctgcaagatcccattgcaaacaagctggctgttaacagggttagtgttggaaacaacagcaacctatggtggaaggtggggcttggggtgggatatggcttttctgaaaggagtcagattggcaagtgatggggaagaggaggcagggagctgatagagtccatgtctgatggtcttacaaaaacctttttacaagtatgagacaagcatgtctgatgggactggagggaagggaagtgggagtgtgagatgaatgaaggcttgaatagaacccaaagggactaggtaaaggaattgaacaagcataagtaacagaatttatgggtgacaatgagggttcagctgaggttgtagaccaggaattatgtagaacctgggtataggagcagacaaggcaggctagagcattagcacaggtttgggattttcatgggcagttgtggcagagggatgaaggtatatggatatggaaggtactggtgagagtggttcaaatgttgagccatctggagtccaggatgggtatggggggaagatagatcagcagaaggcaagtggaccaagagacaatgtggggctcaagagactgtggtcttgataaagttgaagaacagatagagcaggagtgagctgtggttggaaagtgggaattcttgaatttaagatttcagagggggcagttctggttggtcaggtccataaatgaaaaagaaagggcagatgtacaatattggtagttccattttcttaagatactatctttatttcctcaaggatcttcttacttccctggattttgatattacttggtctcattattatgccaacgtgcctttctcatcacaatattctgctgcctctccacaagcaccagtttttaaatctggtatggttctcatttctagtgtgcctgtgctatccttgctttttagctgacaggtaactgataatacctcttttatccaggagccactgatttttttgcgcagtgtttcagccgtaatcacacatatgggaattcatttccacaatgcttttgatttgtctgtttagtactttatagttgctttggttataattctgcctagactgagcctgtagagcaccaactctggtgtcagattgcctgggcttgaatccctgcaatttcacttacttgctctttattcttgggcaagttagcctaacctctcctgaatcctaatctatacaatgggggtaataatagtcactcattcttggtattgtggcaaggattaaattagttaatatatgttaggtacttgtttggcgtatagtcaattctcaataaaagatactgttggggtgacaatgacagtgattgcaatattggcagcatatgcaaaattgcataccagatattgcattaagtgctagggcagatacagaggagaagattgaaaaagtccttgttttcatggagggtatatattctccttggggataagaactaagaacacttcctcaagactgtctaagaaagggtgtgtgcaagaggcttaacatcttatagttcaataaagaccaggaaatatacaagttgaggaaatattgaggtttcaggaacctgtatagctttgccgtgttgtttatgttctccactgttttgtagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcagatacattttttcttcctgaggtccagccctgtgtctccaactatttcctgggcccagttacctggatatcaagtatgcaacactaacttaatagggttaaaacaaaactttttgccttacttccaaacctgtttctttccttacatcttctattgctatgagggctgtcactagccagtcagttgtttaatcttgactgtgaactaggcatctttgacttcaccttcttcatcctctctgctcagtcagtctccctattctgtcaattctacttctcaaacctattctgttttttcttgctgcctggctcaggcctttatcattttagaagattcagcaagtatttgtactccaaacattgtgattggccctttaacacacattatttaattttttaaacaacgtttgaggtgggtcgttttgtagatgagaaaccaaagagtcagaaataaaatgacttctgctgggcacggtggctctgtctatagttccagctacttgggaggctgaggcaggaagatcacttgagcccaggaatttgagtccaggctgggcaacatagtgaaactctgtctctaaaaatgaaaaataaaatgaaatgaaaaataaaatgactggtctaattgtttagaggcacagttagtaaatctagattgtcttttgctgcagtattgtaataatatctctgcctcatttgtattgttttcttttttgagatataaatggaagatatatgtaaaaacaaattagaactatgtgaagtaaaaagtgaaagttgccccttcccaattctactccccaagggaaaccaatgatagtggcttttgttctagacctttctctttgcatatacaaatatttagataaattctttataaaagatcattttttattgtcctacaactactttttcactcatggccatatttttatgtcagtacgtgtgtatctaccacatttttaatggcgacataatgttccattatggggacatattattttgtttaatgattcctatgttaaataactgtttctgttcttacaaataatgttgcagtaatagtcttgtgcatatactcttgcttgtgcatttgtatgaatatttctattaggtaaattcttagaagtcatattgcttggttaagtatatgcctattttaaatgtatgtactaccaaattgtcctctgatttgtcctctaaatcagtctttcatattataactagagcgatatagctataatatgtctttgtaaagtgaatttcatcatgtgatttcccagcatcaaaaagcaacatcagagatgtttggtggatttctattgtctatgcagtaaattttaaaattaaaaaaaattttttccagacaggatcttgctttgttgcccaggctagagtgggccacatgtgatggcgtgatctcagctcactgtagcctcaacctcacaggctcaaacaatcctcccacttcagcctcccgagtagctgggaatgcagccgtgtaccatcatggctagctaagttttgatttttctttttgtagagactgagtcgccctgtgttgcccaggctggtcttgaactcctaggctcaagagatcctcctgcctcagcctcccaaagtgctgggattacaggtgagagcctccatgctgagccaaaattcttaaaattttaaaaaagtttttaagagttatgtaatctggtcccaaactatctttcctaccattcttccctaccaggaaatttgtcctctgataaggcaaaatccacctcttctgtgaaatttcccatgtatactgctctctttcctctctctatgcaagatagaatgagttgctttcttccctaagttctcatagcacttaatttatagtcccttataatccctctgatagcacttaatgcgttgtactgtatttatgtgtgtctgtctcccctgctactctgtgattttcataagggtaggaactgtgccttactcatctttgtatccccagcactttacacaatgcctgtcagcgtagtgctcaacaagtgttcatgaatttgggaaagatatcctggaggtagtgctagagtgctagtatgataagaactttgagagatagagtagggggtggaagttttgaagtatagcagaaagctgactgactcctgggagaatggaagctggttaggaatagacaactgggcttaaactggcaggagccttcatgtgcttttctccttcactgcagagaccagctgcctggttatttgggttaataggcttgagatttgagaacatttaaagtattaaaaattggatgattgaggactcacttggtggagggggagattgactcagctgttctatgttctttccagactaagatgcatatactgaataaccaatccttttcccagagtcacgaataactttttctttctgaaaaatcaaggactcttcattttcagggcatgtttcggatgggagtaggaagactaaataggtcagatacttctactttgtctctttagcttggctcaaggggaaaggaacctattgaaagggtttagggctgtgggcctattcttgagtaaatcatctgtgtgaaattagttcttttgtcatttcaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggtaagagttccccaaaacgcatggggtcccaggcctttgaccaatgatgtctgggcttttccttatgtctcccacctgactttcataggaatttgtatatgtgatgtttaccactacttattgggtcacgctgggctctgagtttgttgcttccacagaaccaaatagtcttactgtctttacctctcaacccctctccatccaatctatgcatatcctgaatccacttacgcttctgttttgggtcttggcaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatgtgagtgtcacctatggctgagtagagagggggcgaggccttggccgtggtgagaatttctttcctcagcctttattagacaagaaccattctttatccatctgtcattttcttttatttcttcccagagagttgaagaaagcaactggggactggttttatgaccagaaagtgaatcgctttgcttaccgcacaggtagtgagataatcaggatgtccctgcgccacaaacctgcaggtactggacctgtctagagatggttcttggtatggaatcctagtgtattctgactggtagcatcttaactccatgggctcagccagttagtggagaatagaagattgtattgtcatcccttctgcaagcatggtgtatttcaggggatttgctatgagggttgtttcctttttcccctactcataaccaccaccctggcatacttttctttgtcttgaagtgagtaaaagagagacagtgggacagtccctccttcatcagacacagatgggtgacatctggccaggaagaaagatcattcaggagcggcagaaggagcccaggtaagaatcaagtaattgtttaaagaaatgcttacaatatccctttaattcttttactattctttttacttcttctgtttataaaataatagatgttcattataggaaaacttgaaaagtacagaaaatagtaaaggagggaaaaaatcattcctaatcccactactcatatgtagacattaacattttggtatatttacttagttctttattttttatagtttgcattcgctttctcaggttgaatagtttgttctttatacgaacaatttgaagacaaataaaaataacacatgctcattattaagcaacaaatcacccacattcctactaccccagttttcacattatgtgaaaattatttcgtatatcttctatgtatatacataacgggttgactggatggataaactgaaaaatctttttaatattggatcatagtataataaattaaaatcatcctatttaattttacttgaatttaacagaataaaacactgaaataaaatgaaagaatagctaatcttcagacaaatgtttttttaaagtaaaagatattagttgttaacattcctctaagcttaagaaaaaatattatgaaagccattgagcagttggtcacttttttagtggagtttttttggtaacagccttattgagatatatataattcacatactatacaatttgtccatttttggtgtacaatgcaatagtttttagtatattcactgagttttgcaaccatcccttgaatcaattttagaaaattttcatcacctcaaaaagaaaccctttacccttttagctgtcaccctccctgatccctaaacaatcactcatctactttctgtctctctgtatttgcctatcctgggtatttcatgtaaattgaatcatacaatatgtggtcctttttgacttgcctctttcacttaacattaacgttttcaaggttcatccatgttatagcatgtatcagaacttcattcctttttatagccaaataataccccatgatatgtatttatcacattttatctgttcatctgttgaagaacatttgggttgtttctactttttggttattaagagtaatgctgggccaggcgcagtggctcacgcctgtaatcccagcactttgggaggctgaggcgggtggatcatgaagtcaggagatcgagaccatcctagccaacatggtgaaaccccatctctaccaaaaaaaaaaaaaaaaaaaattagccaggtgtggtggcacgcacctgtagtcccagctactcgggaggctgaggcaggggaatcacttgaacctgggaggcagaggttgtagagagccgagatcgcgccattgcactccagcctggcaacagagtgagactccgtttcaaaaaaaaaaaaaaaaaaaaaaaaagagtaatgctgctatgaacattcattaagagttttgtgtggatgtatgttttcttttctttttttttcttttcttttcttttttcttttcttttctttttcttttcttttcttttgagacggagtttcgctcttgttgcccaggctggagtgcagtggcgccatctcggctcactgcaaccttcacctcccaggttcaagcgattttcctgcctcagcttcttgagtagctgggattacaggcacgcgtcactaagcccagctaattttcatatttttagtagagacggggtttcaccatgttggccagactggtcttgaactcctgacttcaagtgatccacctgccttggtctcccaaaatgttgggattacaggtgtgagtcaccatgcctggcctgttttcatttttctaaggtggatactttggagttagccgtcattttaaaaatctgcctgtttcaatatttaacattatcagtgggcgctttgctgtgaaagaggaagcagttagctttcttacacttcccccggttattttcttctatccccactatttgttactcaaattatttttcctttgtcagggtttataatatttacattctcttatataaccataaaccatctgtttgttttatctgtttgtttccttttagttttatacttaaaaggattgtatgcttacaaccaggccttataccacaacttctctatttctgatttatttcttggttttctggatttcatcattgaggaggtccttcaagaagagcttgcaggtgctatatttattgtattcttacacgttaagaatgtctgccagctgcctttatacttgaatggtatcttggctggatattatattcttgggccacattttctttccctcagaatgttgtagacattgttccattgtcttcttccattgaatgtaactgtgaagaagtctgaggacatcttggcccttgtctttctttcttatggatgagagagagagagaaagagaaagagaaagggagagagattggacttgcctgaaaattttcttttctttttcttgaagtttagtaatttaagggctgggcacagtggctcactcctgtaatcccagcactttgggaggccaaggtgggcggatcacaaggtcaggagatcgagaccatcccggctaacacggtgaaaccccgtctctaataaaaatacaaaaaaattagccgggcgtggtggcgggtgcctgtagtcccagctgctggggagactgaggcaggagaatggcgtgaacccgcgaggcggagcttgcactgagccaagattgctccactgcactccagcctgggcaacagagcaagactccatctcaaaaaataaaaaataaaaaaaaagtttagtaatttaacaaggttgtaactcaatggtgatcattctgtatcatttttccctatatgtgatatatccttgatgagttctttcttcattgctggaaaatttttctgtatcatgtctcagaactctttttctttctgttttattatttaagttctccacctcagagatactggattttcttatcctctatttttgtcattttcttttactagcgaatggaataggaaaaatggtgaaagcaattaactgtgattagcccaacccattcctccatgctattaatttggttttcagtttatttccctcccctaccccttttcccctcccttccttactttttgctgcttctaatttaattatttgagtaaattatcttatttaggttttgatttgttctttgctctaatcttctttctctcattttgttttatcatcttgtatttgaattcttgcactttattgaatttatattattagttcccctgtagtgtaaagcactcacatgaaacctacttgttttcctagggttaaattcttctccagactcggttcttcatccatcttgcaaattgttttcatttctctccacttcatggctatttatatatctgccagactattatttcattttactgaactttaatatgggaagttttgtctgtatcttttgtttcctctgatatagcatatgtgagttcttctcaccttaacttgaaacaatttatcttttccccattcccagctgtactttagtttaaggactgaatattgctttttatatttctttccttgtaacctgaaggggtaggtgcagaaggcaacttggagtcctgagttttggtctcatgaaattctcttaaatgtcctggttcagggcttacctgtcccagatctgggttaatcccctagctcataccagtgccctgggagatgacattttgcatcagtcttgtctgtctctgttgaggttctacagtggtacctggggctataaatcttgaggacttctgtttttcttgactactcactcacttaatctgcaaattgctacattggaaaggattagttaaggagctttgctgaattaaatcttctgttttcttaggtgcgatttttgaaatctgtgacttgaggctttatttttgactcatttggttgtggcggtgaatttttagcttttgtatggtgtgtgtgtggtttttttttcccctaactttcactcacccaaagggaaatgactttatcatgtttcatatgattgttgaaaaacagcatagaaatgtataaagtaagtcctccagtaacctcactgcttcttccccagataattatcgttaatagttgtgaatagttttggcatatggactaccaagctgtctaaatatacatatatgggttgggttcctaagtttttaatttctttttctttaaaggatgatactataaacatgttaagtgaaaaaaagtgaaagaaaaagaactttaaaaactcaataatacagacaatcccatagaaaatgcacaaaaaatttgaacagacatttcaccaaagacaatatagagatgtcagataagcacatgaaaaggtgctcaacatctttagtcattaaataaatttgacctaaaaatcacaataagatactactacatacccattagaatgactaaaattaaaaagactgaccatgccaattgttggtgaggatgtaaaacaactggatttaaaaaaaattttcttttctacatttcctccttgctattataaacaactagcattcttatacactgctggtgggaatgtacaatggcatagctactttgaaaagcagtttagcagtattttaaaaagttcattgtgcacctaccttgtgattaagtcatttcattcctgggtacttactcaagagaagggaaaacgtatgtttgtacaaagacttctacgtgaatgttcatagcagctttatttgtaatagcccaaccctggaaataacccaaatgctcatcagcaggtgaatggataaactgatttgtttatacggtggaatactactcagcaatggaaagaaatgaactattgatacacgcaataacatgaatgaatctcaaaataatcatgctgagtgaaagaagccaagcagtaaagagtacatactgtatggttctgtttgtataaaaactagaaaatacaaactagaaagcagtgacagaaagcagatcaacacttacaggaagggcaggagggattagaatggggcaggaggaaacctttgggagtgaaagatatgttcattaacttaattgtggtgatagtttcgcagatgtctacatttgtcaaaatgtcacgttgcacacttgaacatgtgcagcttatttatgtcagttattactcaaagcgtaaaagaaaaaaattgtagaaggatataacatgaacatctttctgtgtcagcaccaaggatctgtttcattcttttgacatctgtatgatgtttcattgtatatatggactgtgatttttatctacacagccttgggtgggtgactcatccgttccaggtgatgaggcccccttttttctttgtggattaaggataagaatggcttttatttgctgaacctgattaacacatctgacatcatcagtcagaatgtaatttctgaaacctattgcttctggttgtctgtgatctcttgtctcattggacccagaagactcttatttatcctaaacatgaaaacagattaagtgaccataaatgatctttcccatgaaattatggagcctcagagataatttaattcaaccaccctatttttgcagaaaagaaagcaggataagtgatttacctgagatcatacagatagttagagcccagggctcccatctcttagtctattttttactgcacagatgtcaaataattgcttttctgcccttgggttgtttgtattagctgtggattggtatgtattaatctttaggaaaaaaaggaaaaaccactctccatggaccattgttaaaactacctctctggaggaatggttctgcttgggtttttttggcgggggtgggggtggggacaaaaggggaaaaaggacaattctaaagtaaaaaatgaaatcaagcccccctgctatgtcttgtgctatacaagtaatacatctttcaaggaatgactgacatttcacctcttgtaagtactaggatttcagccctgctgtctgttttcacagaactgtcaaacatcatgtgacaacttggagagtttattctttactggctaagacattatagattttggttacctcattctttgtgcatctattagtttgtttgtttgacaaatatctatgaatgcctactatgtgccaggcattgttttagaccctgagatacactggtgaatacaaggcctcttgtttgtggggcttagatttccggggtgggagataaaaagatagtcaagtaaatgtatggtatatcagatgttgacaggtgctgtggagaaaatgaagtagaccaaaggtatagggagtgccaggaatgaatgtgtgtacatatactgtttaggatagccagggcaagtcttaacaacagggtaacgtttgagcaaagatatgaaaaaaatgagggagcaaacccttagggtatctgggggaagagcatgtagatagagaaagaaggaggtataaagaccctagggtgagattttgtttggcacttttgagtaatctgaaactgagtgagcaagggaggctgaggaaggagttgaggacagagatgggatgagaagcagatcatgttaagactttggtggcacttgtaagcattctgtcttttactccaagtaagaaggatggctctgaggggcacagccttattttgtcttctttttaaaaatggaggtaaagttgacataacataaaatcattttaatcaattttaaagtataaagttctgtgattgttagtactttcagaatgttgtgaaattagatcaccactatctaatttcagaacattttcaccatcccaaatagaaacccgatagccattaagtagccacctccatttaccccagcccctaatatgctttctgtcttgatggatttgcctaatctagacatttcatataaatgcagtcatgcaatatgtggccttttgtgtttggcttatttcaattagcataatgatttcaaagttcatccatgttgcagcatgtatcagaatttcattgtcttttattgatgaataatccattatatgaatataccacatttcatttgtctaatcatgcattgatggacatttaggatgttttcatcttttggctattaggaataatgctgctatgaacattcatgtaacatttttgtgtggacatatattgtttagttctgttgggtaggtacccaggaatggaattgctgggtcatatgatagttctatccctgatttacattttaaaagctcattttggctgttgagggaaagtcaaagccaagggaagaagcaggattagttaggaggctactgcaaccatccaagagctacatgatggtggtttggaccagagtaatggcagtggaggcagtgagaacgtatcagagtctaggtatacattgaagaggatttgctgacagatttgatttgtattgtgagaaaaagaggagtaaccgatgattcttagcgtttttgacttgagaaatgaaagggaattgccatttgatgagacagagcgaagagcagttttgggggaagattagggctttggttttgggcttgctgtgtttgagacatccacgtggagacattgaggaggccattggaaaaacaagtctggagtttgagtaagagataaatttgaggccgggcatgatggctcacgcctgtaatcccaacactttgggaggctgaggcggatggatcacctgaggtcaggagctcaagaccagcctggccaacatggtgaaaacctgtctctactaaaaataaaaaaattagccagccatggtggcacaaacctgtaatcccagctactcaagaggctgaggcaggagatcgcttgaacccaggaggtggaggttgtagtgagccgagattgtgccactgcactccagcctgggtgacagagactccatctcaaaaaacataaaaaataaaaataaatatatttgagttattagtttattgaggatatttaaagccatgagactagatgagatcatttagggataattctagatagagaggaggagcagcccaaggaagaagtttggacataatctaaatattagaggtctacgggaggaggaaggactagcaaaggagactgagaagcagcagccagtgaggttggaggaggaaaccaggagagtgtggtgtccggggagccaagggaagttatttgagatatttgaggaagaatcgatgttttttcccccttttcctgctgctctcactaattctttgaggtaaggggccgaggaaccgtatccttcccttgaaagatgagaactggtattttgaatgcccagagtcatccttcattaaggcgattaagctaaaaaaaagaattctggtcacctgaatactgtcttctagacatactgcttatttatggatatatctcagtcccactgagggcatttattcaataattcagtcaataaaaatacttgagtgcatactctatgctagtctctcttcaaggcactgagaacacatcagtaaataagatacgtggtcactgatcttatggaactttgtcgaatggaggagaaagacattaaataatttgtttaaattattgaaccaaataaataatttgtttaaaatacataaatagttacatatgtggtgactgttactaggaaatcaggatgctatgggagcacagaggaaggttactaatcgagacttagggtgggggcatggccagagagatctggaggaattgacatataaggagagacctgaagcaggagtagattgaggcaggtgaagaaaagtggccattgtgaaaagaatatcttaggcagataaaagagggaagatggagagcttcaggatattcagagaaacaaaataactttgtctttctaaaatataaagcttgaaggaggagtagggggtgaaaaatgagactggagagggtgagcaggggccaaatcatgaggatttcttgccatgctaaggagtttcagctaaatcccaacagcaatggggaaccactgaagagttttaaaagtatactgagggccgggtgtggtggcttacgcctgtaatcccagcactttgggaggccgaggcaggcggatcacgaggtcaggagatcgagaccatcctggctaacacattgaaaccccatctctactaaaaatacaaagaaattagccgggcatggtggcacgcacctgtagtcccagctactcgggaggctgaggcaggagaatggcgtgaacccaggaggcggagcttgcagtgagccaagatcgcgccactgcactccaacctgggagacagagtgagactccgtctcaaaaaaaaaaagtatactcagctgggcaccatggtacatgcctgtactcagctggtacaccatggtacagttactcagaaggctgaggcagcagggttgcttgagcctaggagttagagactgttgtgcactatgatggcacctgtgaatagccacagtactccagcctgggcaacattgcgagaccttatttcttaattaattaatttattatatgtttaaagtatactcatatttattttagaaagatcactcaggctacgattgtgaatggattggaaagaggcctgactagaggcaggagaacctgcttcctttcaatattggctcttggtttttattctagtgtgctatttgaagtgccaaagctgaaaagtggaaagagtgcattggaagctgagagtgagagtctggatagcttcacagctgactcggatagcacctccaggtggggttccccccatttccctcatctcctctcaacccaagttgtgattttgttctgcagcatcagtgttcctgacttctgtcctcaggaagttgaacgaagtattttctctgtcctcaacagaagtcttttcagtagcacgtctactgatttggctctgagcacagcttcctggaacacattgacatctctagtcaattcccccagtatcttggagtattcttcttagcccagtagcaactgatgctgctgtcccttaagaatgagggtgtgagtgtttgtgtttgtgcaaagttgcctatctgatcttctgcattccttccaggtaaatcacatgcgaagtgtaccttctgaatttggttattacgatgacccaagccattggctctccttccatagagctttgatccctgggtagaaggggaagggtaggaggtgacttagttataatttctgaatctacctccaggagagactctctggataaatctggcctctttccagaatggaagaagatgtctgctcccaaatctcaagtagaaaaggtaagcttcaggttattgagccaccttcctcccctcccttccttccctttctcctttacctcctgtctccctccgtctttccctccctccctccccctcactcttctcttcctctttcttccctccctccctccattctcttaggcagaatttaaatcaggaatttcaactaaacaaatttcagttcaaattcacttgggagcattttctgaagttttgtttgaaatgtgtgagaaaataggttttgtactatttctaggcatttaatctttcctttaagtttgtcatagtttagcgaaaatctgagccttattcttcttaagactgtccttccttactcactccttctacctatccatctgttcttttccattttcttgcccttgttccttcctaggaaactcagcctggaggtcaaaatgtggtatttgtggatgagggtgagatgatatttaagaagaacaccagaaaaatcctcaggccttcaggtaactggtttcccttactggtctttcaggactgaagttctgagtacccttgatgggctcttggtatggagaagaataggtctctttgatttggcttttttggtcttcccctcagagtacactaaatctgtgatagatcttcgcccagaagatgtggtacatgaaagtggctccttgggagacagaagcaaatccgtcccaggcctcaatgtggatatggtaggtgcccttatattttacttggtcactatatgaaattttacttatctggagttggctttagtacctgatattctcagtcaacctatttaattctttaagaaaaggcaacatgaaacttgatacccccaagtttctaaagtaaatctggttcctgatttgcttaaaggaaaggactgtctttgctatctcttttttttttttttttttttttttgagacggagtttcgctcttgtttctcaggctggagtgcaatggcacgatctcggctcactgcaacctccgcctcctgggttcaagcagttctcctgcctcagcctcctgagtagctgggattacaggtgtgcgccaccatgcctgggtaattttttatatttttagtagatatggggtttcaccatgttggccaggctggtcgcaaactcctgacctcaggtgatccacctgcctcggcctcccaatttttttttttttttttaagagacagcatctcactctgtttcccagactggagtgtagtggtacaattatagctcagtgccaccttgaactcctgagctcaagctgtcctcccacctcagcctcctgagtagctgggactataggcatgaaccatcatacccagctaattttttttttttttttgagagatgggagtctcactgtatttcccagcctggtcttgaactcctaggctcaagtgatccgcccgcctctgcctcccaaagtgctggaattacaggcatgagccatcacgcctgaccatctcttttattttctaataaattgctggatatatggctggggctcaaataaatacttcttttgattaaaatgtaaacagggttggggaaagtcaaatggaaaagagttatagcttctatgaaaaacattaaatattcttatcttattcttttgagatatgagaaggatggttggaatagagctgggaaccctgaaatgggaagacatgtaaaaagaaggatatgaggccaggcatggtggctcatgcctgtaatctcagcactttgggaggccgaggcaggcggatcacctgagatcaggagtttgagaccagcctggccatcatggagaaaccctgtctctactaaaaatacaaaaattagccaggtgtggtggcgggtgcctgtaatcccagctactctggaggctgaagcaggagaattgcttgaacccaggaggcggaggttgcggtgagctgagattgcgccattgccctccagcctgggcaacaagagtgagactccgtctcaaaaaaaaaaaaaaaaaagaagtatgtgtgcgtacacatacacatggcaacttggagctttaaaggaaagatattagtctttgaagctaaagaaaagtctttcttttattaactctgaatttatatttattgttccaggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaaaagaaagaaagaaattttgtattaagcagcacagatatgcatccatgtatttatatgtatttttttctttttttacacaaatgggttcacatggacctcattgtacacatttttttttttcatttatcatgggcatccttttgtgccatcacttacagatctatctcattttaattgctgctgcatagtattttttcatgtgcctgtattataatttatttaccattcccccactaataggcctttaagttgtttgaattcttttttgctcttaaaactatgctgtaatatatcttggtcttcttttgtgaatgtaactgtcagagaagttcctgttggtggaattgctgagtgaaaggaaatataaatccaatattttgatagctgttgcccttgcaaaaaaaaatagtgacaacattaaatttgtccctttaaatactaataaaaacaggaatttgttcaacagcacagtaggatgactatagtcaacaaaaatatttgtatttcaaaatagctagaagatttgaaatgtttccagtgcaaaaaaatgataaatgttcaaaatgatggatgtaacaaaatatcacatgtaccccataaatatatacaaatattatatgtcaataaaaagacaggaaagaaattattaccaaagtataacatattattacaaatttagaattttttaaccatttggcacccaagtcattctctacggtcaatataattatattggaaatgtcactgtaaaccatcatgaactactgccaataaaacttttatataaagagaagaaaccacattaacatggaggtctttgctctttgtaaatatttggagccagaataagaatgtgctactaaaacaaatatgccagtttctagctaatgctaaactccaatttttaagagtccactgaagttcacagaacttttctaaaaaataattttctagaaattaataaattgtgtagacattttataaacaacagaaagaccattcccatattatatatcgattttaacttctacatttgttgtttctggttttgtttttgttttttgttttttccctagcaatccatttgctcctattcagttttcccttgcctgcatctacctcccgattcttttgtctctctcacatatattaaactgtgtgttctgggtatgtggtatgttgatccaaacttatggggattatgccttcctagcattggtaaggacctaagttagaggaaccccaattaacacaggcaaggccaagtgcagtggctcctgcttgtaatcccagcactttgggaggctgaggtgggtggatcgcttcagctcaggagttctggaccagcctgggcaacatggcaaaaccccacctctacaaaaattagctgggtgtggtggtgtgcgcctgtagtcccagctactcgggaggctgacgctggagaatcacttgagcttgggaggcagaggttgctgtgagccgagattgcgccattgcattctagcctgcctgggctctgggaatgaaaccctgtctcaaaaaaaaaaaaaaaaaaaaaaaaaatacaggcaggtgaaagggcacctctagtctgcaccagctcatgctctggatactaaagcacaaggaacaaagtcatgccgagagagccaatcgagtgaagcagttctgccaatcaaagccaaagacaataggccacctgctgctcatctcagacattcattcgttcactcttaccttcattcagtaaatatttgtggagcacctactatgtgccagatactttgctaagtgttgggcatactaggatgaacaaaaataggcttgatttctgtctcttggcacttcggctgcagtgttagagacagacattgatcaaagataacttaaatgcaaaatttataattgtggcaaatccaaattcgtgtaacagagtttcacctagccctcaaatctttgcaagccctccttttttctttttttggggggagggacagggtctggctctgtcgcccaggctggagtgcggtggtgcgatcttggctcactgcaacctccgcctcctgggttcaagtgattctcatgcctcagcctcccaagtagctgggattataggcccacaccaccccgtcggctgatttctgtgttttttgttgagacaaggttttgctgtgttgtccagactggtctcgaactcctggactcaagcatttgcccacctcagcctcccaaaatgctgggattacaaatgtgagccactgcacctgactgaaagccctctttttttttttcccctgcaagccttctttttaaaaataccttgtaaaaatactttgtatttttaaaaaccatacaaatgatatatactattctcattaaaaggacactaaaagttaatatggagtaaaaaagggaaagttgtctttcatttccctattctgttgccctccctagaggaaacgaggataagtttgttcgtatcctgggtttttctatgcagtgtagtataatgtttaaaagcacggactctggaaccagtctgtctgaatttgaatcctagctctgccaattactaactgtgtgaccttgggcaagttacttagcttctctgttcctctcttccatcagttgtaaaatggagttaatagtacctgtctcatagagacagtcatcaaacaaaatgatacacctaaagtacttataacagtgcctagtacatagtaagggctaacataagtgataatggcaatcgttatttacatacatttatattcacatgtacaactatgaatatattttaatataagtggaacatttttctgcatcttgctttgttgacttaaccctatgtcttggatatctttccatgtcagcatgtacagattcactgaattcttttttgatgactgcatgccatatgccataccaggacactacaattattcatttaactctttctatagtgattgacatttaggtcgtttccactttttggctattactaacaatgctggtagcaagattctctgtcatgctgtcagtccttcgtgagtttgtatggcaaccttgcttgaagatctttgagagtatttggaatctagtaactatgcccccaaagtggcataatagtgggtattgcagaagactctttgttggttctgccctatttccttctaaagaaactgccatagaaacctgtggctgccatggcctagggacggtggattatattcatatgaagaaggatcctcttttgccctgatgctgttcttggggggtaattttagaatttttttcagagagaagtcccaacaattcttgagaagcccagcttgacctgttgggtttccctgtgtttcagatcagtgctgagtccccgactggcttgccatcacacaaaggcgagttggtggtttcattgaaatacatcccagcctccaaaacccctgttggaggtgaccggaaaaagagtgagttttctttggggtcctggatgtagcttagtcttctgcataggatctgtgcaaggccggtgctggctactggttagcactgttggagagaccaaattgggatgctccctggatctgctagggagattcctttactaaggaagcctctctgcgttttttcaaacagaagggaatgccttagggttggcattcttttctttttttaggctattaaatggacttggtcttggtccagctgtggcaagctactaagagggcagaagagaacagaaactttggggctgagaagggtggctgggagaggtggtaaagtatgaaggacaggaagttgaaagctggggaagagtaattcaacatgccagctgctgtgttagtgactacggttgtgtagatgagtaaaacatatttgctttcccttgaggagcttaagtttttgcaagaaagacagtcatgtgctaaaaggacacagatataggagtggtgaattatgtctggttacatttgggagagctttgaagaagtaacattaaaactggatcttaaaactttaccagacagaaaaggagcaggatgaggagagaagagcattttcagaagaggggataacatgcgcaaaggttttaaaaaggcatggtaatgtggggttgtatgtgagtgtgtcccttattttagtgggactggagttctggtacactagatgtaggtgtggggctggagttggacatgaggtgggagcctgactgaagagggccttgaacttaatgataaagagtttcacttgatcccttggcaatgtgtggcctacgttctttgaaaaaatatacctttggcagagtcacatctagaaggtttgggggaatcaatgaaatccccaatgagggtatgtagcatgactagagaagagaggcaagtatagaaccagagagatcagcaacattttaaaggatgaagagagaaagaaacaccagtgaagtaaaaggttatcaggagagagcttcaagaagaaggggcggaggttatcaacagtattgaaatactacagggaggtcagaccagatgaggtctgagaagacatggccaattggcattagattgcattttcagtggatcagtgaaagcagaaaccagatttcactagaaactaggctgagtgaatgggcaaagaagtagaggtggtaagtgtggactttttttcctcaggataattgatggtgaaagaaagtagagacatggagaatagcttgaagaagagataaggttaaagggagcttttcttttagaagtactttttcaaagagatgagattagtatatatttagactgaggggaagggacaagtggagaaagagatatttaaattgggaggtgaggattgaaattgatgatgtctgaagagtcctgtgaagtaggggtggaatcgagaactcagatggaggagttccctcttttttaaatcattgaacaaatatcaggcaactttatgtctctaagcctcaattttctcatgtacaaaatgaggacaaaaatagtgtgactctcctagggttgttttgagaattaaatgcttaacatggtatctggcacatagccagttttcaataggcatttattaatattgtggttgttattaatacagcacctattgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaaggggtgagtccctagaccagccccaaattaaccagtttcagaacaagagagctaagagaagaatttaactttctctgtggatattatccagtgtgtcttaccactcccggcaaccaaatttgttcctgaaattaggtaatgacaaaaccttcaccacctttgcactggtctgggctgtagacttgataatccaaagaggagggctgcagacaggttctgacttttgtctgactcatgttcttaattaattctgggtgaaaatctgtgtcttctgactgtctagatttgggaactcagggctttgtttcccacagtttttaagctttccgaaaattacagattacctactgacttaatttatctagaaatcatgtttggctaagtttatagatattactattggttttatttaaagagataaattgtctagtagaaacaaagccaaatatttaaaacccattttcagtggagcacagaatagcctcactaatactattatattcattttctctctaggttaaaggaattgaatcaggtgaatgatctagtagaggtagtgggaactctgcttcagcagattcaaggaggggcgtgtgtagtaggatctggatgtgggttcatcttcttgggctaggcctgtggtaggggaaaggggaatttagagagataactgtccgctttgagtaggctgttgattactccccgccctctgccagatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactggtgagatcccctcccccatcctcacttgtttgaaggcttcttgtctattttactcctattaccattcccgccccccaacacaaagctcctctgtgatgacagttgtcttctttcctttcagttaacattcagccaatacttattgagtgcctactatgtgccaggactaggggaaggctgagctcatgcactgatatgtgcacagataaatgtgaccctgattgccaggaacttcataatcttcccaccaaaaaaatctacaaacctacctatatgtatgtacctatacattccatcttccatgctgttaataatgaaagaagggtcattgctagcaaaagccaagctctctccaagtgctctgggccacctccccctacccttctcgatgacctcacttctataatcgtcatctctcagtttcatcctccctacctaccaggggtgaatacagatatgctctggtatttccaatcttatgaaacaaaaacaaacctttccttgactacacgttccccttctagtttcttagaaagaattgtctccacttctcacctctccttcagctctccttcactgtgatctggcttttgtcccaccactctgctgagcagttgctcttgccaaagtgttgttctcatctcactagaattttcagcactatttaacatgctagatcactccttttcgcttgaaacgctgaacttctattgacactgcattctgattcccttttaagtcactgctcaccccttctcagttttctttgtaggtgctgcattctatacccaaactctaaatgttggtgcttggcagagcttagtctcggatcctcttctttgccctctccctagtctctgcacttgtctattaatatacttatatattaataatcacacagaatatttaacatgaagcatatagactgatgtttttacacatgtaagccaattcatgtcagtcccctgttaaaacccctcagtggctttctgttgtgcttagaaaacaatccaaagttcttaacatgcctacaggcccctgtgtaacctgggtcctctgttcctttctgatccgtcttgtatcactcttccccttgctcactatgcttcaaccaaaatgactttctgctctccaaatataccaagctcattcccacttcagaacctttgcaattattgttttctctgaatggaaagtctggttctttcttatccttcaggtcttggctcaaatgtcaccttctcagagagtcctcagaccactccatctgcacagtagttcctgagtcagtcactatacatcaccctgtttatttacatcataatgttaacctcactgtctgaaatactcttattggtttgcttgtatattttctgtcttccctattcaaatgaaagttgcctgaggacagagactttttctgctttgtttactagtgtctctagagcctagaagagtacctggcacacagtaggcactcaataaatgtttgctgaattaatggatgaatatataagagaatatgaatggggccacatacgatcctcacttctgacctggagtctgcagctagaggagaggtgtttagctttaaaagaaaaaagttggccgggcacggtggctcacacctgtaatcccagcactttgggaggctgaggcaggcagatcacgaggtcaagagatcgagaccatcctagccaacatggtgaaaccccgtctctactaaaaatacaaaaaaattagctgggcgtggtggcgcaggcctgtagtcccaggtactctggaggctgaggcgggagaatcgcttgaacccaggaagcagaagttgcagtgagccaagattgtgccactgcactccagcctggcgacagagcgaggctccgtctcaaattaataataataataaaagaaaaatgtttaagtacagttggcaatagctctggcatgagttgtcaggcactagaactctgtaacagcctcagaataagaagtctctagtgactgtgtgccatttggagtctgatttcatcaacccagagtctcttgacagagtctcaggaatacaggtgagggagcacttcccagactgctgtggccattagcccatcttcgtaggaaactgttatggggtggctaatcttgctgtacaacccatcttccctggtgggctgagagtggggcccctctttagcctcttctggtgtttctcctcagggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgt

SEQ ID NO: 4783 - DNA, 16425 bp, human
ttctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatggtaagtgaagcaaacgggtgatgaggagcgcactcccatgggattgcgaggacctctccccttttttccttctcagtttctggtcccacccccttagcccctatccccacctggaccctccgttctcaacaactttgcagctcggaaggagcagctgggcaagagcgatttcttttgtgggctatgctgttctggagccactgaatgccagttgggggaggggttgcgcagcgaataccccccatcccaagtaaaccagaaggctgagacctgcgtagcacctgtcattggcaggagcccttccctccttccagcacacacccaaagtccgggcaaccagtatacaagtctgattccctccctgtgagctaagagtttagcaagcggagagtttatttattttagagcagaacaaaagggaaagaggaaaagagctgggaaaaatgggctactaaaacaagcaatttttaggggctgactggtattcctcatcccaggcagacagctgatagtattcctccagccacctgggtatgtatctggatccttgagacaaagcattcttggcccaaataaaggtcactaagctcttgtttcttccccttctctcaagggagagctagatgttttgttttattttgttttgtgtgtggggtaatctacaaaatctgcaaagtctgctttttctctcccgcaaacagtccgtaatccccaccttgccttctgtggatgaccagagccaggccctctgcaggttttcccctctgcagagttggaatcaatcacggaaggtgactggccaaaacatctcctctgcaacctgggggctgggctgctttccccagttgggcgtgatgaggacttgctcttatgctgtggagtactaggagatggcagggaatgtttccagcactttcgggtctgtcccttcttcccctgtcactttgcctcttcttttccccaccccagctgcttctcgtcgcctttgccagacttccaataatgggaaggagcacatcattgggctctcaaggtcaagagagaaaggagcttaggggaggaacagaaggggaaagagaaaagaggcaagcccttttagggctgaggcagggaggaacagcctcacacattgcgaggaattcatagctctcctgaacccactgcagagctttccagggccccttaacgtgagctgcaaatggatggagactggcaaattatattaatagatgctcagaaaatgtttgcaggcagctctggcttctgtctcagggtttaagctggagctttccatttcttcctcaccgcaggatcaccctagggttggggagggtgacaagggcttaggtctagccccagtggcaaatccttacatgcttctccttctcccttcccctcctcccagcatgtttgaccagatggaattgaaatcaggtcaaaatgagtacccgaggcagcctgcactgggagaagagggacagggtggggtagcagaagccaccaaatggcttgaagaggttgggacagagggacagggtggaggggaaatgccattatatttctgtcttggtggtagcagtttggtgttagattatgaataaatgaacatgctcttgctttacttttcatatgtacatatatttatatatttgtgtgtgtgcatcataggtatgtgtaagctttccctagccttagggacacactacctttcttcagtatactccctgccctccagaccctagtcagctgcttcagaggcccccccaagctgcaccctaagtacagtgttaggctctgcaggcaatccaactaagatggagtcaccgggaagcttcctaccagcttagcaggagctcacaaggaggaccagccacaaatgggtttacagtatgtttcttcctagaaatggagctgtctagtgcagcctaatgaaaggcagaagaaacaaatatgaagatttcatatcatacataggaacatatttaaatagatatagtgtaacacagcaatatagaaccattgtgtgtgggtgtgtatgcacacttctgcacttctgtgctaggggcatctagagggaatggaaagattgtatctaactgagaagtagacgtcacaatagtttgaagaggattttcagactgcccttttccagggtcctctcctgcattgagcatcgggccatagactggagattgctctctggcataaagcctactgcatagtgcctgggcttggcccagctttattctcgttcccataggaaagggagggaaattcagttctagtacagagaaggtgctcaatatgtatttgtggagtggttgggtgaatgaatgagtcattgtagcattgccttggcttgttaccacccttcagatttctctgtttggctcttgattatgcagttcaggagccatttcttgcctcttagagggactctctaagaagcccctgtctctcagaggcagagtctctcagaaccccaaccctagatcagctgggatgattatctgggattttttgttttccattaaggagtggattcctctgcatcgaggaggttagtcatgtattgactgcagtggcatttcttataagatctcaaagcgttgttgctgctgttgttgttttaagattatttgttctttagaacatgtctgtgaggtagatttagtgtattcgttatttttattttactgatggataaactaaagcagaacaagtttaatgacatatccaaggccagaaaggtaagctgttgttggagcagagatgagaaaccaagtccatgactcaatactcccaatagaaagatcattaatggttaaaactgttggtttttatggatgccagaactgacaaccgattcttgagaacacctggcacagtcttcctccttttattgtaccagtttaactgcccaatgcatattttcaattttgttttactacaaaatcaatttttaaaatttagatttttgatttgatttcttttttctttttctttctttctttttttttttttttttttttttgcttttctgccaactattttttttcttgttttaaaatcatttgtgtaattcttaggtgttatcttctccagggagaatcattgctaaaaaaccaaacaaatgactatgaacttttctcctgtttctactggagaagccagcaagggttagtggaaagagtgcaggctttatggtcacacaggcttgggttcaggtcctgctactcttggtgtctcagtttctttattcttaaaatggggataagaatgcctaccacttaagaaacagaccatcctaagggcggggggtggggggaaggagtgcctaccttagaaggctgtaaacattaactgagattatgtataaaagtgtctggtacagtgtttgctatagtatgtgttcaagaaatgctttgggtgaggtgattatgataagtaattctgttttatggagtggtttcctaactgatttaaatagctagtttaagggattgaaatcaagcatatatatatatttatttatttatgagacggagttttgctcttgttgcccaggctggagtgcaatggtatgatcttgggtcactgcaacctctgcctcccgggttcaagcgattctcctgcctcagcctccggagtagctgggattacaggtgcgtgccaccatgcctgcctaatttttgtatttttagtagagatggggtttcactgtgttggtcagtctggttgcgaactcctgacctcaggtgatccacccatctcagcctcccaaagtgctgggattacaggtgtgagccaccacccccagcctgaaatcaagcatttagaagaacaagatgctattttcatgtgcccttgtggacagacctttatgcaatcaattaatattgaaaaatccacacttgctgctgtgtagtgtacagtggatctcatgcagaacttccagatgcatctctgaatagcccatttggcatgtgttgtcccatacctcctccagatttagcaagtatcattatagagtactctaaatcccacgtgaattcaacatgactggccactcccttgactaaatgcctttattagttcacttgaaaatgggagacagcccttaaaagtgctgggacgcagtttcctgtgcagtgactgggaacatataaatagttggcttgctttaaatctggtgttcagctttttgtagtagtggcttcatcctgtaagcacaggggaccacatatgaaaagataagaaaacaccaaaatcctggtgacaataaagccaagagattttggtcctgaggatgactgggcaagtccctgattctttgcatcccctcatagtaaaggtttgttgatttgatttatttgtttatgtgtagttaagtgcccttctgtttatgtaatcctgaggaaacactcccaatatgtttgggcagtttatttaatgtccataggtaatcttttaagcttccaatcactgctattaattgctttccaactaggtaataagatagtaatttactgatgtttagactgctctctgaggtggtacagtacatttattttcagagaggaaaccgagaccctgagaggtgaagcagctttgcttaattcacacagcctgccatcacaagctaaactacatattagagtttatgttggggagcttgtagcctctcagtatggacaaaagctgagtttgtttcagacagatctttgactgacagtaggagtcagtcttctgccctaagatgcaatctgggaagggtccactttgactggtacgatcaagcatgccagcttcctctttaggtgggcattacatgacagtggaaagtagaataggtcgggagttcaagaccaggctgaccaacatggagaagccccatctctactaaaaatacaaaattagccaggcatggtggcgcatgcctgtaatcccagctactctggtggctgaggcaagagaatcacttgaacctgggaggcggaggttgtgctgaaccgagatcacaccattgcactccagcctgggcaacaagagggaaactccatctcaaaaaaaaaaaaaaaaaaaaaaaagaaggtgtttagcattcatgtggcaatttggcaattaaatatgtaatggctttttattacatttaaacaatgatctatgattcacacaggctttatttcttacagagattcagaaaaatcacacatgagtcagtacattttgcagcacttatgtaggctttatggtttaagatagcaaccaggctgagattttttgccaaaatatatttttatcagtgctttcttctgctttcatatagttttttttccttgtaaatcttattgaagtataacatatatactgaaacatgcacatagcataagtatgcagctcaaggaattttcagaacattcccatgtaacccagcactcatattaagaaaaagcacattgccaggtgctgtggctcacgcctgtaatcccagcactttgggaggccaaggtgggtggatcacctgaggtcaggagttcgagaccagcctgggcgacatggcaaaaccccgtttctactaaaaatacaaaaattagctgggcttagtggtgggtacctgtaatcccagctacctgggaggctgaagcaggagaattgcttgaacccaggaggcagaggttgcagtgagccaagattgcactactgcactacagcctggacgacagagttagactccatctcaaaaaacaaacaaacaaacaacacaaaacaaaaagaaaaaaaacaaaaaaaaccccacatgaccagcaccccagaaaccttcctcatggccccttccagttactacccccatcaagggtaattactatcctgacttctaacaacataagtcaattgtacctgattttgaattttatataaatggaattctacagtatattagccaatttatcttttccttttacctaattggcatgagtgaactgaagtggacactatttgccctgtgttctcattttgtattttgtcctgttagctggcttgggctggttattaattgtaatcaaagattaatattatttgacagttttgagctgttcaaatataatatcattaatatgagatcatggatcctgctgtgtggtgaagaataaatgacaaaaaggaaaaaaaggtatgactaaagaaaggctctggctgggcgcggtcgctcacgcctgtaatcccagcactttgggaagccaagctgggccgatcacctgaggccaggagttctagaccagcctggccaacatggtgaaaccccatctctaccaaaaatacaaaaattagttgggtgcgtcagcgggcgtctgtagtcccagctgtttgggaggctgaggcaggagaattgcttgaacccgggaggtggaggctgcagtgagccgagatcgtgcagctgcactctagcctgggcgacagagtaagaatccatctcaaaaaaagaaaataataataaattaaaaaaattaaaaggctccataggccaggcgcattggctcacacctgtaatcccagcactttgggaggctgaggcgggcggatcacgaggtcaagagattgagaccatcctggacaacatggtgaaaccctgtctctactaaaaatacacacacacaaaaaaattagctgggcatggtggcacacacctgtaatcccagctactcaggaggctgaggctggagaattgcttgaacccaggaggtagaggttgcagtgagccaagatcgcgccactgcactccagcctggcgacagagcgagactctgtctcaaaaataaaaataaaaataaataaaatttaaaaataacaaaaaataaaaggctccatatgcttttgactcatgtctgaatcataatgtcctcataccacaagaatggatctgcttgattcatcaatgattttgttattaaaataattaccgtggcttgcaaaaatatggatttctaattgtgtgggtttttgtttttgtttttgagacagcatctggctctatcactcaggctggagtgaaatggcatggtctcggctcaccgcaacctctgcttcccaggttcaagtgattctcctgcctcagcctcccaagtagttggaactacagacgtgtgccaccacgcttggctaatttttgtatttttagtagagatggggttttgccatgttggccgggctggtctcgaactcctgacctcaagtgatccacccatcttggcctcccacagtgctggggttataggcgtgagccactgcacccggcctaattgtgtggttcattaatgatcaaatgtgtgtgtgttgccctcagctgatgctatgacactttgattatttacctaaatctccaaaatgctcatttgatttattgaatctgaggggaaactgaggtaataaaatacttagtaattttctccaagcaatttagtggcaaaactaaaattggaattcagcttaagaatcccagtccaaggatattgctagatgattgcctttgattgcaggggtttgagacatttaactaagcccatctttttcctgtttttcttccccctatacggaaactatggtttcagagcctgggttattgcagtggaaagaacacagacctaacaaagtgaattgcaagagccttttaagaaagtgaatctgtcaactgtctttattcttactatccatacaattaaagtctttagagacctagttactatagactgaagacatgtgacccttctattgtttaacttgaggtggcctggaccaagcataatgagggggttagcaataataggattctttttttttttttttttttttgagaaggggtttcgctcttgttgcacaagctagagtgccatggtgtggcctcggctcactgcggcctctgcctcccgggttcaagcaattctcctgcctcagcctcccgagtagctgggattacaggcatgcgccactacacccagctaatgttgtatttttagtagagatggggtttcttcatgtttgtcaggctggtctcgaactcccaacctcaggtgatccgcccgcctcagcctcccaaagtgctgggatgacaggcgtgagccactgcgcccggccaataggattcttttgatgtcgctattctactccacaggagaagattgatggcttcctataatgtcaagacccatccaagcttagtcccatctccaataaactaaacattccctctttggagtcctagaaaataaatcctgtctgtacctactcagttttcaatgaaagatttgattaaatggtgtatccacatgcagttttctcttgagaaacagaggaaagaaagaagcaacagcggcataaaaatatacacagctgcagtttaagaggttagctaaactaaaaaagtaatacgccgttctactaaatggagagaaaaaagattactgaagttataggaacttgatttaaaacatggagtttggccccgggctacagattgcactatagtatagataagagtttgtacctgaataatgggtggttaagccctagtcaaaaaagaagtgtttccagaagccattcagccagcatctggaagtcttggctcctaactgactataagaaactcatcctgggctgggcacataacaaggtcaggagtttgagacgagcctggccaacatagtgaaatgtggtgaagtgtctctactaaaaatacaaaaaattagctgggcatggtggcaagcgcctgtagtcccagctactcaggaggctgaggcgggagaatcacttgaacctgggaggcggaggttgtggtgagccgagatcgtgccactgcactccagcctgggcgacagagtgagactccatctcaaaataaataaataaaataaaaataaaaatacaaaaattagccgggcatggtggtgcgcgcctgtagtcacagctacttgggaggctgaggtagaagaatcacttgaatccaggagacagaggttgcagtgaactgagatcatgccactgcactccagcctgggtgacagagccagattccatctcaaaaaaaacaaaaaacaaaaaacaaaacaactcatcctgtcttttgtgtttatcacatcagaagtttacacttaggatttaggaattgcctcttgagaacttttgtgttgctaattagaaatggcccttactgggcaaccgtggtggctcacgcctgtaatcccaacactttgggaggctgaggcaggaggatcacttgagcccaggagtttgagacaggcctaggcaacatagtgagacccagtctctacaaaaaaacttaaaagagattagccaggcatggtggcacaagcctgtaggcccagctaactcgggaggctgaggcgggaggatcacttgagcctgggaggtcgaggctgcagtgagccctgatggtgctgctgtactcccgcctgggtgacagcgagaccctcagaagtgttaagaggccaggcgtggtggctgacgcctgtaatcctaacactttgggagaccgaggcaggtggatcacctgaagtcaggagttcgagaagagcctggccaacatggtgaaaaccagtctctactaaaaatacaaaaattagctggatgtggggtacatgcctgtaaacacagctactcgggaggctgaggcaggagaatcgcttgagctagggaagcataatttgcagtgagccgagccactgcactccagtgtgggtgacagagtgggattctgcctcaaaaaaaaaaagtgttatggaagcctctggggtctacattttttccccgtaatgtccccctgctaccatcaccaggatgcaaagggagaaggataaggcaagtggcatgtatttaggttaatgagaggaaaggggtgggcttctcaccaccaccaggtaccctaaacctcagctcagctctgccccacatgggtctggcccctttcagcccaaggttttactctgcctactggtcaacctctctcctaatttctctatgaaaaatccttgatttaatctaagatgggaagagagaggaagaatgactaacactttgtatttccatataggctcaggaatagggtaggaactagggtgaggtggaattttaaataaggacagtctctgacaaggcaggtttagggagaagtgagtgaagcagggtcgtgcaagtgtagcgtcggagcctacctttatttaaaagtttcatatcttgttcatcatggatattatttacctaatcagtgagtgtttttggtgccctcttaaattttccacccaaggtaagtagccttgctgactttaccttactccaggcttgttcaggacctttcaaataatttgctcagagacacccaactagaaagcggcaggatcactttggaaagttaaggcaggccacatagccaggggctgtctctaaaaaaaaaaaaaaaaaaattagccgggcatgatggtgcataccctgtagtcccagcaacttaggaggctgaggcaaggtgggagaattgcttttgagccccagaggtagaggccgtagtgagctctgatcccaccactgcactccagcctcagtgacagaatgacagtccatatcaaagaaaaaaaaaaaaaaaggctagaaagtggcagagctgggatttgacgctaagtctgtttgcatccaaaccatgcttttttctaaaccattagtcttttaagagtcctcataggcgattatcttgggccactcatgataattaatccattaagtaaaggtgcattcacttgttaatatttgttccaaatctagagtgtgtgaacactattttaagtgccagatgcttctgagaggtcaagttggctttctgcctcattcttacacttgtctagcatttggcacttttgactattctcttcttaaaacttatcttggtgtccatgacctggtctctcctggttttcctcctgcttttctaaccatactttcttctatctgctttgtggactctgtctttccatttctttctttctttttttttttgagacagagtcttgctctgttgcccaggctggtgccatcttgactcactgaaacctctgcctcctgggctcaagtgattctcgtgcctcagcctcccggatagctgggattacaggtgcatgccaccacgcccggctaatttttgtattttttttttttttttttgtagtagagacagggtttcgccatattggccaggctggtctcaaactcctggcctcaagtgatctgcccgcctcggcctcccaaactgctgggattacaggtttgtgccatcacgtccggcctctctttccattttttaaatgtctgtcatgcatttttttcccactgtatataccctccctgggcatactaatgaccatccattctctatctttagtccagacttctcttactgagctgccttaccagtcatctacacttggatgccttagaggtacttcaactcaaaacccccaaattgagttcctcattctttcctgatccctgacccccgcattctgttcctcctgattatctgatatatacccatacttagagaatggtaacacctatctatctctccagcacccaagccagagacctgagaatcattcttgactcttccctttccctcagtgcccacatccaatgagacaccaagttctgtagaattttttttttttttttttgagacggagtcttgttctgttgcccaggctggagtgcaatggcgtgatctcgggtcaccgcaacctctgcctcctgggttcaagcaattctcctgcctcagcctccagagtagctgggacttataggcatgtgccaccacgcctgggtaattttttttgtatttttagtagagacggagtttcatcatgttggccagactggtctcgaactcctgacctcaggcgatccacccgcctcggcctcccaaagtgctgggattacaggcgtgagacactgcacccggccagattttgctttcaaagcattcctctactctgtccccttcccgtgtcctcactgccattatgctagtccacatctcttacctgatctctttgtttccaggcatacttcccccaattcatcctccacactatttctagagggaccatcttttctctctctctctttttttttttttttttccagacagggtcttggtctgcctcccaggctgcagtacgttggcacgatcacagctcactgaagccttgaactcctgggctcaggcaatcctactatctcagcctcccaaatagctgggactacaggcacacactgccacgcccagctaattttttaaaaactttttgtagagacagggtctcactatcttgtccaggctggtttgcactcctgggctcaatcgatcctcctgccttggcctcccaaagtgttgggattacaggcgtgagccaccatgcccggcctatttccagagggaatttctttaaaagttcctcctggcttataagacaaagtccagctccacagcagaacagatattgttctccatgatctaattcatatttatctctcctatttcatgtctcccctccttcccttccctctatcaccctatgctgaactgaagtggtatttggccatatttggtgtgtcagggtctttgctcatccagcttcctctgcctgcagtgccatttccttttttatcttgcaaacacctgctctactttttttttgagatggagtttcaggctggagtgcctcaccacccacttttaagattccactccaaattttctgtcaccatctagggagatttgaccactccctctggtgtgcctatactgttcctgctacataattgtatccagcacttataacactttattgcacttgtgtatttacatatccgctcttccccttataaacttcaagcttcaggaagacaggacctttgaataactgacacttatatccagagtatccagaacagtgcctagcacaaggaggcacttaataaatattgaactcagatgagagcacctcctggaaagcaaaaaaaaaagaaaagaaaaaagagaaaataaacattgaatgaatgaatggatactaaaagaaaacaaagcagtggaccaacccaataagacacttgataaaatctcatcaatttactccaaaatgaggaacaggccaaaatggatagtgaaaaatatgaatgatctgtaactctaagatcaatataattctgttactttgtgatcttatacagatctctatttatgtaccactaactgtgctgctttatgttgtttacatatctgtttccccctactagtctgaaagcttcatgaccctgtctaatttatctctgtatcattgatgcaaaacccataataggtgtacaataaatatttcttgaatcaaaattaaggaatgaggctgggcgcaatggctcacacctgtaattccagcactttgggaggccaaggtgggcagatcacctgaggtcaggagttcgagaccagcctggccaacatggcgaaaccccatctctactaaaaatacaaaaaaaaaaaaaaatcagccaggtgtggtagtgcatggtagctatgtgggaggctgaggcaggagaatcgcttgaacctgggaggcggaggttgcagtgagccaaaattccaccactgcactccagcctgggcgacagagtgagactccgtctcaaaagaataaaaataaataaataaaataaaataaaatttaaggaatgaagctagccaaagtagcttcttataaaggtttggggatttatctcaatgaaatgagaatgattttgtcttactatattttaaagatatataaagggctgacatttgcatacatttttatttttctattttctcagcaaacactttcatttttatagattctacaaatataaactccagcttcgctcttttctgaaatataacaaattccaatttagggaagttcaaattagtgaatctttaccatactgtgccttaccttgtttcattttgcttagtattcatatgcatctgggttttgacaaagcaggcactagaaaatatggatgtggctaacatgtaccagtttttatgggcctagtgaatttttaaaaaattctttttatttatttatttatttgcttatttatttatttatttatttttgagatggagtcttgctctgtcgcccaggctggagcgcagtggcacgatcttggctcactgcaacttctgcctcctgggttcaagtgattctcctgtctcagcctcccgagtagctgggattacaggcatgccccaccacacccggctaatttttgtatttttagcagagatggggtttcaccatgttggccaggctgttctagacctcctgacctcaggtgatctgcccacctcggcctcccaaaatgctgggattacaggcgtgagccactgcacccggctaaaaaaaagtattaatgctatttatgatttataatcataaatgcttttaaactataaaatcaaattattcgccttattacctttggtgcttgtcttagtccattcagactggtataataaaatagcataaactgggtagcttataaacaacagaaatttatttctcatagttctgtaggctgagaagtccaagatcaaggtgggagcagtttggtgtctattgagggcccactttctcttcacagatggtgccttctaactgtgtcctcacatggcagaaggggcaagtcagctctctgaggcctctgttataaaggaattaatctcatttaggaacactccaccctcatggacataatcatttcccaaagccccacctactaataccatcatcttgggggttatgatttcaacatatggtttttgttggggacacaaacattcagaccatagcaaagatgctactaaggtttaaatcacagggattccagcagattgcttgtgtttggattttttttttttgatggagtctcactctgtcgcccaggctggagtgcagtggtgcaatctcagctcgctgcaatctccatctcccgagttcaaaccattcttgtgcctcagactcccaagtagctgggattacaggtgcccgccaccactcctggctaatttttgtatttttagtagagatggggtttcaccatgttggccaagctgtctccaattcccggcctcaggtgatctgcccacctcggcctcccaaagtgctgagattacaggtgtgagccactgtgcctggcctcttagtttaattacatataattaagataagaaaaattatatataatgggacaccagtggctggtgtgaaaggggagaggactctgcttgtgttttcttcattctaatgttaaaatcatggttaatgcagtaatttccttacaatattctcactctagaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtg

SEQ ID NO: 4784 - DNA, 17644 bp, human
ttgaagtttccgtctttcctttagggcttcatttaacttcgagactgtccttttggcctgtgagcacacgtagggcattaggacccagcgtttgttgtagtgagagtggttgaatctcgatctctcaatttttctctcgagctccctcctctccctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatggtaagtgaagcaaacgggtgatgaggagcgcactcccatgggattgcgaggacctctccccttttttccttctcagtttctggtcccacccccttagcccctatccccacctggaccctccgttctcaacaactttgcagctcggaaggagcagctgggcaagagcgatttcttttgtgggctatgctgttctggagccactgaatgccagttgggggaggggttgcgcagcgaataccccccatcccaagtaaaccagaaggctgagacctgcgtagcacctgtcattggcaggagcccttccctccttccagcacacacccaaagtccgggcaaccagtatacaagtctgattccctccctgtgagctaagagtttagcaagcggagagtttatttattttagagcagaacaaaagggaaagaggaaaagagctgggaaaaatgggctactaaaacaagcaatttttaggggctgactggtattcctcatcccaggcagacagctgatagtattcctccagccacctgggtatgtatctggatccttgagacaaagcattcttggcccaaataaaggtcactaagctcttgtttcttccccttctctcaagggagagctagatgttttgttttattttgttttgtgtgtggggtaatctacaaaatctgcaaagtctgctttttctctcccgcaaacagtccgtaatccccaccttgccttctgtggatgaccagagccaggccctctgcaggttttcccctctgcagagttggaatcaatcacggaaggtgactggccaaaacatctcctctgcaacctgggggctgggctgctttccccagttgggcgtgatgaggacttgctcttatgctgtggagtactaggagatggcagggaatgtttccagcactttcgggtctgtcccttcttcccctgtcactttgcctcttcttttccccaccccagctgcttctcgtcgcctttgccagacttccaataatgggaaggagcacatcattgggctctcaaggtcaagagagaaaggagcttaggggaggaacagaaggggaaagagaaaagaggcaagcccttttagggctgaggcagggaggaacagcctcacacattgcgaggaattcatagctctcctgaacccactgcagagctttccagggccccttaacgtgagctgcaaatggatggagactggcaaattatattaatagatgctcagaaaatgtttgcaggcagctctggcttctgtctcagggtttaagctggagctttccatttcttcctcaccgcaggatcaccctagggttggggagggtgacaagggcttaggtctagccccagtggcaaatccttacatgcttctccttctcccttcccctcctcccagcatgtttgaccagatggaattgaaatcaggtcaaaatgagtacccgaggcagcctgcactgggagaagagggacagggtggggtagcagaagccaccaaatggcttgaagaggttgggacagagggacagggtggaggggaaatgccattatatttctgtcttggtggtagcagtttggtgttagattatgaataaatgaacatgctcttgctttacttttcatatgtacatatatttatatatttgtgtgtgtgcatcataggtatgtgtaagctttccctagccttagggacacactacctttcttcagtatactccctgccctccagaccctagtcagctgcttcagaggcccccccaagctgcaccctaagtacagtgttaggctctgcaggcaatccaactaagatggagtcaccgggaagcttcctaccagcttagcaggagctcacaaggaggaccagccacaaatgggtttacagtatgtttcttcctagaaatggagctgtctagtgcagcctaatgaaaggcagaagaaacaaatatgaagatttcatatcatacataggaacatatttaaatagatatagtgtaacacagcaatatagaaccattgtgtgtgggtgtgtatgcacacttctgcacttctgtgctaggggcatctagagggaatggaaagattgtatctaactgagaagtagacgtcacaatagtttgaagaggattttcagactgcccttttccagggtcctctcctgcattgagcatcgggccatagactggagattgctctctggcataaagcctactgcatagtgcctgggcttggcccagctttattctcgttcccataggaaagggagggaaattcagttctagtacagagaaggtgctcaatatgtatttgtggagtggttgggtgaatgaatgagtcattgtagcattgccttggcttgttaccacccttcagatttctctgtttggctcttgattatgcagttcaggagccatttcttgcctcttagagggactctctaagaagcccctgtctctcagaggcagagtctctcagaaccccaaccctagatcagctgggatgattatctgggattttttgttttccattaaggagtggattcctctgcatcgaggaggttagtcatgtattgactgcagtggcatttcttataagatctcaaagcgttgttgctgctgttgttgttttaagattatttgttctttagaacatgtctgtgaggtagatttagtgtattcgttatttttattttactgatggataaactaaagcagaacaagtttaatgacatatccaaggccagaaaggtaagctgttgttggagcagagatgagaaaccaagtccatgactcaatactcccaatagaaagatcattaatggttaaaactgttggtttttatggatgccagaactgacaaccgattcttgagaacacctggcacagtcttcctccttttattgtaccagtttaactgcccaatgcatattttcaattttgttttactacaaaatcaatttttaaaatttagatttttgatttgatttcttttttctttttctttctttctttttttttttttttttttttttgcttttctgccaactattttttttcttgttttaaaatcatttgtgtaattcttaggtgttatcttctccagggagaatcattgctaaaaaaccaaacaaatgactatgaacttttctcctgtttctactggagaagccagcaagggttagtggaaagagtgcaggctttatggtcacacaggcttgggttcaggtcctgctactcttggtgtctcagtttctttattcttaaaatggggataagaatgcctaccacttaagaaacagaccatcctaagggcggggggtggggggaaggagtgcctaccttagaaggctgtaaacattaactgagattatgtataaaagtgtctggtacagtgtttgctatagtatgtgttcaagaaatgctttgggtgaggtgattatgataagtaattctgttttatggagtggtttcctaactgatttaaatagctagtttaagggattgaaatcaagcatatatatatatttatttatttatgagacggagttttgctcttgttgcccaggctggagtgcaatggtatgatcttgggtcactgcaacctctgcctcccgggttcaagcgattctcctgcctcagcctccggagtagctgggattacaggtgcgtgccaccatgcctgcctaatttttgtatttttagtagagatggggtttcactgtgttggtcagtctggttgcgaactcctgacctcaggtgatccacccatctcagcctcccaaagtgctgggattacaggtgtgagccaccacccccagcctgaaatcaagcatttagaagaacaagatgctattttcatgtgcccttgtggacagacctttatgcaatcaattaatattgaaaaatccacacttgctgctgtgtagtgtacagtggatctcatgcagaacttccagatgcatctctgaatagcccatttggcatgtgttgtcccatacctcctccagatttagcaagtatcattatagagtactctaaatcccacgtgaattcaacatgactggccactcccttgactaaatgcctttattagttcacttgaaaatgggagacagcccttaaaagtgctgggacgcagtttcctgtgcagtgactgggaacatataaatagttggcttgctttaaatctggtgttcagctttttgtagtagtggcttcatcctgtaagcacaggggaccacatatgaaaagataagaaaacaccaaaatcctggtgacaataaagccaagagattttggtcctgaggatgactgggcaagtccctgattctttgcatcccctcatagtaaaggtttgttgatttgatttatttgtttatgtgtagttaagtgcccttctgtttatgtaatcctgaggaaacactcccaatatgtttgggcagtttatttaatgtccataggtaatcttttaagcttccaatcactgctattaattgctttccaactaggtaataagatagtaatttactgatgtttagactgctctctgaggtggtacagtacatttattttcagagaggaaaccgagaccctgagaggtgaagcagctttgcttaattcacacagcctgccatcacaagctaaactacatattagagtttatgttggggagcttgtagcctctcagtatggacaaaagctgagtttgtttcagacagatctttgactgacagtaggagtcagtcttctgccctaagatgcaatctgggaagggtccactttgactggtacgatcaagcatgccagcttcctctttaggtgggcattacatgacagtggaaagtagaataggtcgggagttcaagaccaggctgaccaacatggagaagccccatctctactaaaaatacaaaattagccaggcatggtggcgcatgcctgtaatcccagctactctggtggctgaggcaagagaatcacttgaacctgggaggcggaggttgtgctgaaccgagatcacaccattgcactccagcctgggcaacaagagggaaactccatctcaaaaaaaaaaaaaaaaaaaaaaaagaaggtgtttagcattcatgtggcaatttggcaattaaatatgtaatggctttttattacatttaaacaatgatctatgattcacacaggctttatttcttacagagattcagaaaaatcacacatgagtcagtacattttgcagcacttatgtaggctttatggtttaagatagcaaccaggctgagattttttgccaaaatatatttttatcagtgctttcttctgctttcatatagttttttttccttgtaaatcttattgaagtataacatatatactgaaacatgcacatagcataagtatgcagctcaaggaattttcagaacattcccatgtaacccagcactcatattaagaaaaagcacattgccaggtgctgtggctcacgcctgtaatcccagcactttgggaggccaaggtgggtggatcacctgaggtcaggagttcgagaccagcctgggcgacatggcaaaaccccgtttctactaaaaatacaaaaattagctgggcttagtggtgggtacctgtaatcccagctacctgggaggctgaagcaggagaattgcttgaacccaggaggcagaggttgcagtgagccaagattgcactactgcactacagcctggacgacagagttagactccatctcaaaaaacaaacaaacaaacaacacaaaacaaaaagaaaaaaaacaaaaaaaaccccacatgaccagcaccccagaaaccttcctcatggccccttccagttactacccccatcaagggtaattactatcctgacttctaacaacataagtcaattgtacctgattttgaattttatataaatggaattctacagtatattagccaatttatcttttccttttacctaattggcatgagtgaactgaagtggacactatttgccctgtgttctcattttgtattttgtcctgttagctggcttgggctggttattaattgtaatcaaagattaatattatttgacagttttgagctgttcaaatataatatcattaatatgagatcatggatcctgctgtgtggtgaagaataaatgacaaaaaggaaaaaaaggtatgactaaagaaaggctctggctgggcgcggtcgctcacgcctgtaatcccagcactttgggaagccaagctgggccgatcacctgaggccaggagttctagaccagcctggccaacatggtgaaaccccatctctaccaaaaatacaaaaattagttgggtgcgtcagcgggcgtctgtagtcccagctgtttgggaggctgaggcaggagaattgcttgaacccgggaggtggaggctgcagtgagccgagatcgtgcagctgcactctagcctgggcgacagagtaagaatccatctcaaaaaaagaaaataataataaattaaaaaaattaaaaggctccataggccaggcgcattggctcacacctgtaatcccagcactttgggaggctgaggcgggcggatcacgaggtcaagagattgagaccatcctggacaacatggtgaaaccctgtctctactaaaaatacacacacacaaaaaaattagctgggcatggtggcacacacctgtaatcccagctactcaggaggctgaggctggagaattgcttgaacccaggaggtagaggttgcagtgagccaagatcgcgccactgcactccagcctggcgacagagcgagactctgtctcaaaaataaaaataaaaataaataaaatttaaaaataacaaaaaataaaaggctccatatgcttttgactcatgtctgaatcataatgtcctcataccacaagaatggatctgcttgattcatcaatgattttgttattaaaataattaccgtggcttgcaaaaatatggatttctaattgtgtgggtttttgtttttgtttttgagacagcatctggctctatcactcaggctggagtgaaatggcatggtctcggctcaccgcaacctctgcttcccaggttcaagtgattctcctgcctcagcctcccaagtagttggaactacagacgtgtgccaccacgcttggctaatttttgtatttttagtagagatggggttttgccatgttggccgggctggtctcgaactcctgacctcaagtgatccacccatcttggcctcccacagtgctggggttataggcgtgagccactgcacccggcctaattgtgtggttcattaatgatcaaatgtgtgtgtgttgccctcagctgatgctatgacactttgattatttacctaaatctccaaaatgctcatttgatttattgaatctgaggggaaactgaggtaataaaatacttagtaattttctccaagcaatttagtggcaaaactaaaattggaattcagcttaagaatcccagtccaaggatattgctagatgattgcctttgattgcaggggtttgagacatttaactaagcccatctttttcctgtttttcttccccctatacggaaactatggtttcagagcctgggttattgcagtggaaagaacacagacctaacaaagtgaattgcaagagccttttaagaaagtgaatctgtcaactgtctttattcttactatccatacaattaaagtctttagagacctagttactatagactgaagacatgtgacccttctattgtttaacttgaggtggcctggaccaagcataatgagggggttagcaataataggattctttttttttttttttttttttgagaaggggtttcgctcttgttgcacaagctagagtgccatggtgtggcctcggctcactgcggcctctgcctcccgggttcaagcaattctcctgcctcagcctcccgagtagctgggattacaggcatgcgccactacacccagctaatgttgtatttttagtagagatggggtttcttcatgtttgtcaggctggtctcgaactcccaacctcaggtgatccgcccgcctcagcctcccaaagtgctgggatgacaggcgtgagccactgcgcccggccaataggattcttttgatgtcgctattctactccacaggagaagattgatggcttcctataatgtcaagacccatccaagcttagtcccatctccaataaactaaacattccctctttggagtcctagaaaataaatcctgtctgtacctactcagttttcaatgaaagatttgattaaatggtgtatccacatgcagttttctcttgagaaacagaggaaagaaagaagcaacagcggcataaaaatatacacagctgcagtttaagaggttagctaaactaaaaaagtaatacgccgttctactaaatggagagaaaaaagattactgaagttataggaacttgatttaaaacatggagtttggccccgggctacagattgcactatagtatagataagagtttgtacctgaataatgggtggttaagccctagtcaaaaaagaagtgtttccagaagccattcagccagcatctggaagtcttggctcctaactgactataagaaactcatcctgggctgggcacataacaaggtcaggagtttgagacgagcctggccaacatagtgaaatgtggtgaagtgtctctactaaaaatacaaaaaattagctgggcatggtggcaagcgcctgtagtcccagctactcaggaggctgaggcgggagaatcacttgaacctgggaggcggaggttgtggtgagccgagatcgtgccactgcactccagcctgggcgacagagtgagactccatctcaaaataaataaataaaataaaaataaaaatacaaaaattagccgggcatggtggtgcgcgcctgtagtcacagctacttgggaggctgaggtagaagaatcacttgaatccaggagacagaggttgcagtgaactgagatcatgccactgcactccagcctgggtgacagagccagattccatctcaaaaaaaacaaaaaacaaaaaacaaaacaactcatcctgtcttttgtgtttatcacatcagaagtttacacttaggatttaggaattgcctcttgagaacttttgtgttgctaattagaaatggcccttactgggcaaccgtggtggctcacgcctgtaatcccaacactttgggaggctgaggcaggaggatcacttgagcccaggagtttgagacaggcctaggcaacatagtgagacccagtctctacaaaaaaacttaaaagagattagccaggcatggtggcacaagcctgtaggcccagctaactcgggaggctgaggcgggaggatcacttgagcctgggaggtcgaggctgcagtgagccctgatggtgctgctgtactcccgcctgggtgacagcgagaccctcagaagtgttaagaggccaggcgtggtggctgacgcctgtaatcctaacactttgggagaccgaggcaggtggatcacctgaagtcaggagttcgagaagagcctggccaacatggtgaaaaccagtctctactaaaaatacaaaaattagctggatgtggggtacatgcctgtaaacacagctactcgggaggctgaggcaggagaatcgcttgagctagggaagcataatttgcagtgagccgagccactgcactccagtgtgggtgacagagtgggattctgcctcaaaaaaaaaaagtgttatggaagcctctggggtctacattttttccccgtaatgtccccctgctaccatcaccaggatgcaaagggagaaggataaggcaagtggcatgtatttaggttaatgagaggaaaggggtgggcttctcaccaccaccaggtaccctaaacctcagctcagctctgccccacatgggtctggcccctttcagcccaaggttttactctgcctactggtcaacctctctcctaatttctctatgaaaaatccttgatttaatctaagatgggaagagagaggaagaatgactaacactttgtatttccatataggctcaggaatagggtaggaactagggtgaggtggaattttaaataaggacagtctctgacaaggcaggtttagggagaagtgagtgaagcagggtcgtgcaagtgtagcgtcggagcctacctttatttaaaagtttcatatcttgttcatcatggatattatttacctaatcagtgagtgtttttggtgccctcttaaattttccacccaaggtaagtagccttgctgactttaccttactccaggcttgttcaggacctttcaaataatttgctcagagacacccaactagaaagcggcaggatcactttggaaagttaaggcaggccacatagccaggggctgtctctaaaaaaaaaaaaaaaaaaattagccgggcatgatggtgcataccctgtagtcccagcaacttaggaggctgaggcaaggtgggagaattgcttttgagccccagaggtagaggccgtagtgagctctgatcccaccactgcactccagcctcagtgacagaatgacagtccatatcaaagaaaaaaaaaaaaaaaggctagaaagtggcagagctgggatttgacgctaagtctgtttgcatccaaaccatgcttttttctaaaccattagtcttttaagagtcctcataggcgattatcttgggccactcatgataattaatccattaagtaaaggtgcattcacttgttaatatttgttccaaatctagagtgtgtgaacactattttaagtgccagatgcttctgagaggtcaagttggctttctgcctcattcttacacttgtctagcatttggcacttttgactattctcttcttaaaacttatcttggtgtccatgacctggtctctcctggttttcctcctgcttttctaaccatactttcttctatctgctttgtggactctgtctttccatttctttctttctttttttttttgagacagagtcttgctctgttgcccaggctggtgccatcttgactcactgaaacctctgcctcctgggctcaagtgattctcgtgcctcagcctcccggatagctgggattacaggtgcatgccaccacgcccggctaatttttgtattttttttttttttttttgtagtagagacagggtttcgccatattggccaggctggtctcaaactcctggcctcaagtgatctgcccgcctcggcctcccaaactgctgggattacaggtttgtgccatcacgtccggcctctctttccattttttaaatgtctgtcatgcatttttttcccactgtatataccctccctgggcatactaatgaccatccattctctatctttagtccagacttctcttactgagctgccttaccagtcatctacacttggatgccttagaggtacttcaactcaaaacccccaaattgagttcctcattctttcctgatccctgacccccgcattctgttcctcctgattatctgatatatacccatacttagagaatggtaacacctatctatctctccagcacccaagccagagacctgagaatcattcttgactcttccctttccctcagtgcccacatccaatgagacaccaagttctgtagaattttttttttttttttttgagacggagtcttgttctgttgcccaggctggagtgcaatggcgtgatctcgggtcaccgcaacctctgcctcctgggttcaagcaattctcctgcctcagcctccagagtagctgggacttataggcatgtgccaccacgcctgggtaattttttttgtatttttagtagagacggagtttcatcatgttggccagactggtctcgaactcctgacctcaggcgatccacccgcctcggcctcccaaagtgctgggattacaggcgtgagacactgcacccggccagattttgctttcaaagcattcctctactctgtccccttcccgtgtcctcactgccattatgctagtccacatctcttacctgatctctttgtttccaggcatacttcccccaattcatcctccacactatttctagagggaccatcttttctctctctctctttttttttttttttttccagacagggtcttggtctgcctcccaggctgcagtacgttggcacgatcacagctcactgaagccttgaactcctgggctcaggcaatcctactatctcagcctcccaaatagctgggactacaggcacacactgccacgcccagctaattttttaaaaactttttgtagagacagggtctcactatcttgtccaggctggtttgcactcctgggctcaatcgatcctcctgccttggcctcccaaagtgttgggattacaggcgtgagccaccatgcccggcctatttccagagggaatttctttaaaagttcctcctggcttataagacaaagtccagctccacagcagaacagatattgttctccatgatctaattcatatttatctctcctatttcatgtctcccctccttcccttccctctatcaccctatgctgaactgaagtggtatttggccatatttggtgtgtcagggtctttgctcatccagcttcctctgcctgcagtgccatttccttttttatcttgcaaacacctgctctactttttttttgagatggagtttcaggctggagtgcctcaccacccacttttaagattccactccaaattttctgtcaccatctagggagatttgaccactccctctggtgtgcctatactgttcctgctacataattgtatccagcacttataacactttattgcacttgtgtatttacatatccgctcttccccttataaacttcaagcttcaggaagacaggacctttgaataactgacacttatatccagagtatccagaacagtgcctagcacaaggaggcacttaataaatattgaactcagatgagagcacctcctggaaagcaaaaaaaaaagaaaagaaaaaagagaaaataaacattgaatgaatgaatggatactaaaagaaaacaaagcagtggaccaacccaataagacacttgataaaatctcatcaatttactccaaaatgaggaacaggccaaaatggatagtgaaaaatatgaatgatctgtaactctaagatcaatataattctgttactttgtgatcttatacagatctctatttatgtaccactaactgtgctgctttatgttgtttacatatctgtttccccctactagtctgaaagcttcatgaccctgtctaatttatctctgtatcattgatgcaaaacccataataggtgtacaataaatatttcttgaatcaaaattaaggaatgaggctgggcgcaatggctcacacctgtaattccagcactttgggaggccaaggtgggcagatcacctgaggtcaggagttcgagaccagcctggccaacatggcgaaaccccatctctactaaaaatacaaaaaaaaaaaaaaatcagccaggtgtggtagtgcatggtagctatgtgggaggctgaggcaggagaatcgcttgaacctgggaggcggaggttgcagtgagccaaaattccaccactgcactccagcctgggcgacagagtgagactccgtctcaaaagaataaaaataaataaataaaataaaataaaatttaaggaatgaagctagccaaagtagcttcttataaaggtttggggatttatctcaatgaaatgagaatgattttgtcttactatattttaaagatatataaagggctgacatttgcatacatttttatttttctattttctcagcaaacactttcatttttatagattctacaaatataaactccagcttcgctcttttctgaaatataacaaattccaatttagggaagttcaaattagtgaatctttaccatactgtgccttaccttgtttcattttgcttagtattcatatgcatctgggttttgacaaagcaggcactagaaaatatggatgtggctaacatgtaccagtttttatgggcctagtgaatttttaaaaaattctttttatttatttatttatttgcttatttatttatttatttatttttgagatggagtcttgctctgtcgcccaggctggagcgcagtggcacgatcttggctcactgcaacttctgcctcctgggttcaagtgattctcctgtctcagcctcccgagtagctgggattacaggcatgccccaccacacccggctaatttttgtatttttagcagagatggggtttcaccatgttggccaggctgttctagacctcctgacctcaggtgatctgcccacctcggcctcccaaaatgctgggattacaggcgtgagccactgcacccggctaaaaaaaagtattaatgctatttatgatttataatcataaatgcttttaaactataaaatcaaattattcgccttattacctttggtgcttgtcttagtccattcagactggtataataaaatagcataaactgggtagcttataaacaacagaaatttatttctcatagttctgtaggctgagaagtccaagatcaaggtgggagcagtttggtgtctattgagggcccactttctcttcacagatggtgccttctaactgtgtcctcacatggcagaaggggcaagtcagctctctgaggcctctgttataaaggaattaatctcatttaggaacactccaccctcatggacataatcatttcccaaagccccacctactaataccatcatcttgggggttatgatttcaacatatggtttttgttggggacacaaacattcagaccatagcaaagatgctactaaggtttaaatcacagggattccagcagattgcttgtgtttggattttttttttttgatggagtctcactctgtcgcccaggctggagtgcagtggtgcaatctcagctcgctgcaatctccatctcccgagttcaaaccattcttgtgcctcagactcccaagtagctgggattacaggtgcccgccaccactcctggctaatttttgtatttttagtagagatggggtttcaccatgttggccaagctgtctccaattcccggcctcaggtgatctgcccacctcggcctcccaaagtgctgagattacaggtgtgagccactgtgcctggcctcttagtttaattacatataattaagataagaaaaattatatataatgggacaccagtggctggtgtgaaaggggagaggactctgcttgtgttttcttcattctaatgttaaaatcatggttaatgcagtaatttccttacaatattctcactctagaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcgcgcgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggagg

SEQ ID NO: 4785 - DNA, 32951 bp, human; identical to SEQ ID NO: 3515

SEQ ID NO: 4786 - DNA, 44552 bp, human; identical to SEQ ID NO: 3516

SEQ ID NO: 4787 - DNA, 44728 bp, human; identical to SEQ ID NO: 3517

SEQ ID NO: 4788 - DNA, 44711 bp, human; identical to SEQ ID NO: 3518

SEQ ID NO: 4789 - DNA, 884 bp, human
ggccgcggccgggctggggcttcagcgggaggcagcagaggggaagtggtcagcgtggcgaatgacggaaggtggcgagggagaggaagaggggtcgggtgtccgcggagctccaagagggaagacaatcgctttgccaaacacggcagggcatctggaaaggcctgggaacctcacccgccctcccaggcccttcgggctcttttcggtcccattaggaggagggggagggcggcaggtgggaccgggcacaggcctagtcgtgcgacaggagaagggaaggaagggccggccccagctgggtcctccttgcgtctggcctgtgccggacgcccccgactccgagtgatctcgggccggtccccgggggagtccagcttctcgcgccaggggagttctcagccccagggcagtccagggattaggcggaagggggcacgcagccacctggccggggcagggggagctgcgaggagccttttttttttttttttttcctgcgcagagccccttgcgtgacacacagtaggcgctcaatacatgtttattttcagttgagtgttgcttcagcttttatggcttgtgataaatccttatccttctgttctagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaatta

SEQ ID NO: 4790 - DNA, 27834 bp, human
cggccgcggccgggctggggcttcagcgggaggcagcagaggggaagtggtcagcgtggcgaatgacggaaggtggcgagggagaggaagaggggtcgggtgtccgcggagctccaagagggaagacaatcgctttgccaaacacggcagggcatctggaaaggcctgggaacctcacccgccctcccaggcccttcgggctcttttcggtcccattaggaggagggggagggcggcaggtgggaccgggcacaggcctagtcgtgcgacaggagaagggaaggaagggccggccccagctgggtcctccttgcgtctggcctgtgccggacgcccccgactccgagtgatctcgggccggtccccgggggagtccagcttctcgcgccaggggagttctcagccccagggcagtccagggattaggcggaagggggcacgcagccacctggccggggcagggggagctgcgaggagccttttttttttttttttttcctgcgcagagccccttgcgtgacacacagtaggcgctcaatacatgtttattttcagttgagtgttgcttcagcttttatggcttgtgataaatccttatccttctgttctagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaattagtgcttggtggttctcaaattatttcacgcgtggtagttttgatttttgcttttccagtgaggctgtacctttcatccttaggcaaatatgatggctttcaaaagcagctatggggtgggaactgggagtggctgcaaatgggcatggagcgtcttttagagataacgaaaatgtcccaacttagattgtggtgatagttcgcacaactctataaattactaaaaactattgaatttgcacttgaaaagggggagaactttatgaaatataaattataactcaaagaagctcttaaaatgcctatggaataataagtaaagagtagtggggatatgatctattttgtggggagactagcagcaaagtaagacataaagataaagaaacatacactggcctgaggaagtaacaaagtctctttgagcaaactttggacaggctcctctcagctttcttttcaactacaccttgtccttgggccctgtcctcggcctgcctagcccagttttagcaagagtcctgctgagtaactccctcacccttgatacctgatcaccttgtcctgccttgagcgagaatcctgtttagtcagttgagcaagaatccccctacccttgatatctctctccccttaggaattttctttctactgactccctcactctgctgcttgactgtaaatccacacttgtcctagttgtctttggattgagcttagttctatactgaagtctcttttcctctattataatagtactcaaaatatggctttactgcttttgactagtatctggctctgtttcccattggcggaaggcactctcagacagtgcttctagtagtatatattagcatgacctgccagggtacaattctttttaaaaagaccaccaattggctggatgcagtggctcacgcctgtaatcccagcactctgggaggccgaggcgggtggatcaggtcaggagttcgagacgagcctggccaacatggtgaaacccccatctctactagaaatacaaaaattagctgggcatggtggtgtgcgcctgtaatcccagctacttgggaggctgaggcaggagaatcacttgaatgcaggaggcggaggttgcaatgagccaagattgtgccactgcactccagcttgggtgacagagtgggcctccgtctcaaaaaaaaacaaaaacaaaaaaaagaccaccaatttattgccaggcattgtactgggtgctgaggaaatttgaggaaaaacacctattaagttcctgtcctcaaggagctcatagtacagtggggagccaagtagcaagcaaatagccatgcaagtgtataattgcaatgaggacaagtatcatgaaaaggagggtacatggtgcaatgagagcctataaaataggggtattcgactagtcaaggtggtcaggaattgcttcaaagaagcagttattgagctgagagttaaaggaagaatagtggctaattagattggaggtgagagttggaggagctggtttgaggctatgtgttcagagatggcatggtgagtaaaagagactgaatgaaagtggctggagttcaacaggcagttgggacagcagtgtgttgggtcagggcatgcagggccttacaagccatcttaagccattcagtctatatcctaagagccattggaagccctgtgggatggggagaacgaatcagatttgtctttgaaaatattgccctgggggccaggcacagtggctcatgcctgtaatcccagcactttgggaggctgaggcaggtggatcacctgaggtcgggcattcgagaccagcctggccaaccaacatggtgaaaccccgtctctactaaaaatacaaaaagttagccgggcatggtggtgcatgcttgtaatcccagctactcgggagggtgaggcaggagaatcgcttgaacccgggaggcagaggttgtggtgagctgagatcgcgccattgcacaccagcctgggcaacaagagcaaaactctgtctcaaaaaaaaaaaaaaaaaaaaagaaaggaaaagaaaatattgccctggctacagtgtggataaaggattgggaaggagtcagaatgtatggagagttttattagaagccatttcaacaatctagagtagaggtaatagtagcttgtactacaatagccatggtttacatggaggggattggtatattttagggtttcttaggaggtaaaatctgcaggacttggcaatggattggaattgggagggagggagtgtgatattgtgaagtacacatttagtctttagtttgttttgtgctgctataacaatacccgatagtgggtaatttataaacagaaatttattgccttacagttctggaagataggaagtctaaggttaaggtgtgggcaggtttggtgtctggtgaggccattctctttttccaagatggtccctgcacacactgtgtcctccagaggggaggaaggctagatcatgacatggcagaagacagaaagaagggccaagagatagagcaagaggagaccgatcttgcccttttataatggcattaatcccacctgtgagggtagagccctcatggcttaatcacctcttaaaagtctcacctcttaatactattactgcaaccgcccagtgggttcaccttgcctgctgcctagacagagatttatcaagacaggagagttgaaatgaagaaagagtaattcacacacagccggctgtgcaggagaccagagttttgttattacttaaatcagtctcccagagcatttgggggatcagttattattattattattattattattattattattattatttgagacagagtcttgctctgttgcccaggctggagtgcaatgatgtgatttcggctcactgcaacctctgcctcccgggttcaagcgattctcctgcctcagcctcccgagtagctgggattacaggtgcccgccactatgccaggccaatttttgtattttttagtagagatggggtttcaccatgttggccaggctggtctcgaactcctgacttcaggtgatccacccgcctcagcctcccaaagtgctgggattacaggcgtgagccaccgtgcctggctgggatcagagtttttaaagataacttggtgggtaggggcttgggaagtacggagtgctgatcagtcaggttggagatggaatcatagggggtcgaagtgagtctttcttgcagttttgtgttctgggtgggatggcagaactggttgagccagattacaggtctgggtggtgtcagctgctccatcgagttcagggtctgaaaagtatctcaggcactgatcttaggtttcacaatagtgatgttatccccaggagcaatttggggaggttcagactcttggagccagaggctgcatgacccctaaactgtaatttctaatcttgtagctaatttgttagtcctgcacaggcagactagtccccaggaaagaaacgcctatgatcaattttgtttcagaatcaaaccacaaactgaattccttcccaaagttagtttgacctatgcccaggaatgaacaaggacagcttaaaggttagaagcaaggtggagtcggttaggtctgatttctttcactgtcataatttcctcagttataattttgcaaaggtgatttcattacaatggcaattaaatttttcatttttattttatttatatatatatatttttgagacggagtctcactatgttgcccagattggagtgcagtggcgcaatcttggctcagtgcaacctctacctcctgggctcaagcgattctcctgcctcagcctcccgagtagctgggattacaggcgcccaccaccatgcccagctaatctttgtatttttactagagacaatgtttcaccatgttggccaggctggtcttgaactcctgacctcaggcgatccactggcctcggccccccaaagtgctgggattacaggcgtgagccaccatgcccatggggcaattaaattttaacatgagttttggagaagacaaacattcaaaccatggtagtcttcatcctcattttcgcgaattacagcttttaaaacccttagaatctctgaggtgatgagagtatcttttgccctgggtggtggctcacgcttgtaatcccagcactttgggaggccgaggtgggcggatcaccaggggtcaggagtttgagaccagcctgaccaacatcgtgaaaccccatctctactaagaatacacaattagccgggcatggtgacacatgcctgtaatcccagctacttgggacgctgaggcaggagaatcgcttgaacctgggaggcggaggttgcagtgagctgagatcacgccattgcactctagcctgggcaacaagagtgaaactccgtctcaaaaaaataaaaataaaaataaaaataaaaaagtatcttttgcatgctaatgagataactggtggctgaggctcctaggtagatttaggacgggggcgctggtcaaggcaggattagagagttgagactttttcaccacacccccagcctctggggaagggagaggagctgaaggttaaattgactagcagtggccaatgatgtaatcaatcatgcctacatagtaaagcctctattttatttattttttatttttatattttgagatggagtctcactcttgttgcccaggctggagtataatggcgtgatcttgcctcactgcaacctccatctcacgggttcaagcgattctcctgcctcagcctcccaagtagctgggattacaggcatgcaccaccacgcctggcaaattttgtatttttagtagagacagggttttgccatgttggtggggctggtctcgaactcctgaccttatgtgatccacccacctcggcctcccaaagtgctgggattacaggcgtgagccaccgtgcctggctgtaaagtctataaaaacccgaaagaattgggtttggagagcttctggatagcgaacacatggaggtacctagagggtgctgtgcttgtagggggcatggaagcttggtgccccttatcctgtaccttgtcctatgtgattgttccatctggctgtccatctatatgctttgtaatatcctttataataaacctgtaaacatgtttttcagagttctgtgaccctctctagcaaattaatcaaacccaaggggagggtcatgggaaccctgatttacagtgggtcagtcagaagcatagcttacaacctggcatctgaagtggagagcagtcttgtgagcctgagctctcaaactgtgggatctgacactatctccaggtaggtagtaacagaactgaattcaattagaggacatccagctggtgtccactgcaaaactgattgcttgatgtatgggaaaattctcccatacatctggggctacagaagcattctatattaaatagagagtataggaaaatccacattttgtttactcccccctgtatcttacagtgagagtgagcggtcaagggtgacttctcagtttctggcttgtacaactggatgtttggagtaacagcattaagaagcaggacctttaagatcacattgaatactaagttcaggtatgaggactgtgagtttagtcttagacatactgtgtttgacgtgcctttgagaacacccaagagaatataggtagttggatggatggatctagagctcagaaggggcctatatattggatatataaattgtgtgctatatggatatagttgataattcaagccatgtgtggggataaggttgtctaggccaaagagtatcagagtgagaatgcaggagatcaaagaaggaggcttgagaaactccagtatttcatgtggagtacaggagagtcagcctgcaaaggagactgggaaacagcagccagggaggtttaaaagaaagttaggagggacttgtgtcattgaagccaaagaaagaaactgtttcaagatgtagggaatggactgttaacaatgtccattgctgctcagaggtcaaataagatgtggactggtaaatatgtgttgcatttaagaatatggaggcattggtgtcctggatggatctattttcatggaatgacggggcagaaatctagaatggaacagattggagtgtggttagcagagagaggaaggcactttttttttttttttttgagacggagtttcactcttgttgcccaagctggagtgcaatggtgcgatctcggctcactgcaacttccgcctcccgggttcaagcaattttcctgcctcagcctcccgagtagctgggattacaggcgcacaccaccatgcccgactaattttttgtatttttagtagaaacggggtttcaccatgttagccaggctggtcttgaactccttacctcaggtgatccgcctacctcagcctcccaaagtgctgggattacaggtgtgaggtactgcgcccagccggtaggcaagtaatggaaacaaagaatataggcagctatttgaagcactttggctgtgaagggcatggaaaagtcagggtagaagcaggagcgagactacgggtcaagagaggcctttcaaattatttatttatttatttttttgagacagggtctcacgctgttgcccaggctggagtgcagtggcacaatcacagctcactgcagccttgatttcttgggctcaggcgattctcccacttcagtcttctgagtagctgggattagaggtgcgcacaccaccacgctgggctaatttttgcattttttgtagacatggggtcttgccatgttacccagtctggtctcgaattccagggctcaagcaatctgcctgccttagcctcccaaagtgctgggattacagtcttgagctgctgcacccagccaaggactttttttaatggagaaattttgtggatgtgtaaagtttacaattaagggtctgtagggagtgagtggttaaaaatacagcagagagatgggataaatcatagagtacgtttgctaagagagaggagcatctggaatcgaaagcataggtggaggaattagtgttcactaaaaggcaagagcatctctgtcttaattgaggaactaactgctggtaggatgtgtgcaggtatagttggtttatgtttggtgttaggaagatgagagacaacttccttctaaaggctcccccaaccccgttattttttctgtaaatgagggtgtggtcatctgcatgtagagataataaggaggaggagttggaaggctgaagagaatggagaaggttcaatgagttgtaagggtgagagcaggttgtaggttgaccagagaaaaatagaaggactgctgagaaatgttgatggctcacttctggttgttgatggtaaatttactatgagccaagctttatttttttctaagtgcttctctaagtgttctagtgttttatttaatccccaaagcagctctatgaggtaggtattattattatcacccccttgtcacagatggtaaaatggaggtacagcaaagttgtgtcatttgtttaaggacaaagagctagctaggtttggagccaggtagtctgactccaaagcccatgatcttaaccatcactctaaaatatatcctaaaaataggtcctgatcatactttttcattgataaacatagatctgtataatcacatttaaggactacattgttggttttatgcttgatggtctgtccagtgacttttccagaaactctctagctgcattcttgagtcaatgccaaatctcagaaaggagagagcttatttgaaccctatgttacaagagttttgatttcctttccttctagtttgttgtattttccaattttctatagagagtacatataattttcattttgtggggaaaaataaagttaacatctctaaaataaaaaagccaggctaggaagggaatagaggtctaagactcagtgtttttaaaatctactatagctaaacatgtttactttgtgtcttagtttattttgtgttactataacagaatatctgagactgtgtaatttataaagaaaagaggtttatttagaggtttatttagttttgcaggctgggaagttcaagggcatggcctcagcttctggtgagagctttctctctctcattttttttttcaagacagagtcttgctctgtcgcccaggctggagtgcaatggtgcaatcttggctcactgcaacctccacctcccaggttcaagcaattctcctgcctcagcctcccacgtagctgggactacaggtgcacgccactgtgtctggctaattttttttgtagttttagtagagatggggttacaccatgttggccaggctggtctcgaactcctgatcacaggtgatccgcctgccttggcctcctaaagtgctgggattacaggcatgagccactgtgcctggccgagagctttcttgacacatcataacatggcagagaaggtcaaaggggaagtgaacacatgtgaagaggcaaaaccttaggggcatcctggctttataaaatcctactcttgtgggaactaattcattcctaagggaatgaatccagttttgaaagagggagaactcactcactaccatgagaatggcaccaagccaatcatgaggtatctgctctcatgacccaaacaccttccattaggccccacctcccaacatgccacattagggatcaaatttcaacatgagttttggtgaggacaaactatatccaaagtatagcattctataattcaacaactccattcctagaaatttcatttcaagagaaattaaagcttatgtgtatataaagacgtgtacaccggtgttcttaccaattttatttataattgccccaaactggaaacagacaaatgtgcataaacaagtgagtagataaactgtggtatatccatacaagggaatactatttagcaataaaaaggaataaatccttcatatatacaccaacatggacaaatctcaaaataattatgctgggtgaaagatgtcagattaaaaaagagagtatatactgtattattacatttatatagtataggaaatgcaaattaatatacattttcagtactcagatcagtggttacctctgaaggtgaggattaactaggaaggggcatgaaggaatcttatgaggtgatggaggtgttttatatcttggtctagttacaccagtgtatacatatcaatttcattaagctgtgcatttgagatttatgcatgttactctgtgaatgttgtatctcagtaaaaaggttaagacaaagtttagctccttttgtcagtctcctttccctttcctttgaccctttcctatatttctttttctctccatctctctctgttctctactttttgtatccatttgagagagagttgatggcacatcaggcactcatgctgactctacacttaaccctgccaattaaatgttcacatcccttcaaatgtacagtttattcaggaaagtaggattgaagaagtctgtggttaaagaatagctcttaggagtgaacatttcttccttttcccttgcacttgaattagatacgtatctttgggccttcacttctgttttggtatttcttttcctttttttttttttttttttttgagacagagcctttgtcacccaggcgggagtgcagtggtgtgatcacagctcactgcagcctcaacctttcgggctcaggcaatcctcctgtctcagcctcccgagtggcatgtgccaccatgcccggctaattttttaagttatttgtagagatggggtctccctatgttgcccagactggtctcgaactcctgggctcaaggaatcctcctgcctcagcctcccaaattgctggaatcacaggcatgagccgctgtgcccagctctgttgtggtatttctttaacagctggcgttataggaatcagacagacttgcctttgaatccctgctgcaccacttgttagctatttgatcctgatacaatgacttatcttctatgatcctcagttttctcatccagagcatgggtataataatgcctacctcctagattgtcttttttttttttttttttttgaggtggagtttcgctcttgtcgtccaggctggagtgcaatgacgtgatcttggctcactgcaaccttagtctcctgggttcaagtgattctccaacctcagcctcccgagtagctgggactacaggcatgcgccaccatgcctggctaatttttgtatttttagtagagatggggtttcaccatgttggccaggctggtctcaaactcctgacctcaggtgatctgcccacctcggcctcccaaagtgttgggattacaggtgtgagccaccgcgcccagccaggtgtcttaagaattaaatgagataatattggtaaagcactttgcctgccatcgagaggccacttaatttcggatggctttcttatttcccaagactgtgaacttgtgacttttgactcttggatgacatctagccctgctccattagacattaaataactctttttattgttactagtataacaactagggagaggacttatacttgcaatatgacttttaaatctgtccttgggctcacataacatgtttcttaccatataagaatggagaaggcttttttattggcttccacgacattcctgggtggttggtttgagacagctagttgttgctatcctgttacagaggtgaaggcaggagaggcatcttgacttcaccaagatcttatatcttgtatggtgataggtctggcactgacaaatgttctatatctttccttgagcagatgtaataagacattacagacatctgagtaaataaaaatagggttatggtttttcttcctaccccagactctaccagatgactcattcctactacatagaaataacagtgaatgtcaaccataacacagatgcctatttatttctctccttactgactcatttttgagagctttttagctagttgtgctatttagttgatctcaaagttatcttctgcagggaagtttcggtggaaagaacactgatatttgttgaatgattgctctgtgtcaaacatagggctagttgtttttaaggaggtctaatcaactctgaggtaataaacactattggattttggagaatgagaaaacttgattgtggaaaacagaaccagtttctagaccgccactcagctaatatgtgacagaagaaatatcccttatccccatccattgattttatttctttttgcttcagatttaaagagcatgtgacaaatagtctagcctttctctgtcttagccccattgcagtcactgttaaccaactatcttcttgaaaccaaaatgactcagcctaaccacagaagcaaatcaaacactgatggcccataatctccagacaaggctttaaccaaacctctgtctatccatctatccatttgttcattcattcaacagatatttgttgagcattgactctttgctagacattgtgtgaggggttgttgttgatgctagagtagaactatttatcttccacaaatgaggcatgaccctgctagggacctgtgttactagcaagcagctttgaggtcagggtaggaagtgaggatagagtctcagaaggaagaaaataaatatttacagagtgtggattgtatccaattcatgggatcctgggaagttcattaactgccaggaggattcctagttctcagctctaggcagcagcatcttggaaggcttctctgaaggtggactccgaaggatctaaggctcagatgttcccctttcagcttctgccctccattccctgcactcctaggtcttagatggtcatgcttgtctctgtatccaaaacctacttttggcacatttttatttcctcccaagctgtaagaacagcttgttcacttgggaaggtcatacttcaaagtggaactctgccatttcagaggggctttgaagatacacagtatacctgggggagtgaaggagttgggtgtcactccccaggataaggcaaacaaaaacaagaacagacacatatcactatgacttaggtatggattaaagattaactgcaccttgcacagaggtggctctcaatacgttttctgcattccatcttgagcatcattttttggctctattgtattctacacttccttcccagaagtttacagtgtttcctaattcactgataagcagttaaaaaattgccccacatttggtattacaaaagtttatgcaccacgtttcttttttttttgagacagagtctcgctctgttgcccaggctggagtgcagtggcacaatctcggctccctgcaagctctgccttccgggttcatgccattctcctgcctcagcctcccgagtagctgggactacaggcacccgccaccatgcccggctaattttttgtatttttaatagagatggggtttcattgtgttagccaggatggtcttgatctcctgaccttgtgatctgcccgcctcagcctcccaaagtgctgggattataggcgtgagccaccacgcctggcctgcaccatgtttcttaaaggcatatatagtgattgttttcttttctagttttgctaatagtgtatgttttgctgatcatgtagtaacagtgttttctttataaatttatgaaagtacaaaaagatatatatgaaaacaaatgagccagaggaaattactattgatattctggcatattttcctccagcttttcaacaaatcttgaatatataatcttgaattactcttttaaaaattgacattataacatacgcattttcctgttttcatttaaaaattcccataaacatctgtttcaaggtttgcatattctcccttttatggctgtaggcaggttcactgaatgacaacttagccttgaagccctctatgaccactcttgaccctatatgtcttgcctctggaatggactgaagcgaagatgagtcccgtgttctctatcccttaatagtggtttcatgtgagggagttctgctttgctggatagggtgaatcacatcctccaagacaccagccttctaaaacatttaccatatagggctgggcgcggtggctcatgcctgtaatcccagcactttgggaggctgaggcagtaggatcacgaagtcaggagttcaagtctagtctgaccaatatggtgaaaccccgtctctactggaaatacagaaattagccaggtgtggtagtgctcgcctgtagtcctagctactcgggaggctgaggcaggagaatcgcttgaacctgggaggcagaggttgcagtgagccgagatcctgcccctgcactccagcctggcaacagagcgagattctgtctcaaaaaaaaccccatgtatatacatatatacgtatatatacacatatatatgtatacatatatgtatatacacatatatacgtatatatatgtgtatatacacgtatatatgtatacatatatgtatatacacatatacacatgtatgtatacatatatatgtatatacgtgtatatatgtatacatatgtgtatatatacacgtatatatacacatatgtatacgtgtgtatatatacgtgtatatacacacacgtatacatacgtatatatatacgtgtatatatacacacatgtatacatatgtgtatatgtgtatatatacacacatgtatacatatatgtgtatatatacacatatgtatacatacacgtgtatatacacacatatgtatacatacacgtgtatatatacacatatgtatacatatatgtgtatacatacgcacgtatacacatgtatgtatacatatttgtatatatactcacatatacacatatgtatacatacatgtgtatatacacgcacacatacacatatatgtgcatatacgcacatatatacatatatgtacacatatgtatatatacacacatatatacatatatgtacacatgtacgtacacatatacatatatgtacctatatgtacatatatacttacatataaacatatgtacatatatgtacatatatacttacatataaacatatgtacatatatgtacatatatacatacatataaacatatatacctgtatgtgtatatgtatacacacacacacacgtacttaggacagtgttgtgcaataggaaggtcttcataaaaacatttttgggaaaagtacttaatttctctgagtctgagtttcctcatctgtcacatctgtttcctcatctgatccatgtggattgcaggtacaacaagtcactgggttgttgtggtgattaaatgagaaaatgtctataaatgaatcccagtgcttggcacatagaatgtgctccataaatgtcagtcattattactattccctgataaatgacgtagtgtggagaagtatcgattgagtacagaaaacaggacagggcttggaagtggtgattaatgatgatgcaaaaaaaaattattctcctgcaaaacctgcttgctttatgcacatttggactattggggcagagaccatggtgggcctgtgggctttgaaaccacctcagaaaacattttgccttagaacattcttttctatttttatttttaaaaagaagatatcttgggtggttatccacttttttttttttttccgagatggggtctggctctgtcgcccaggctggagtgcaatggcttgatcttggctcactgcaacctctgtcctctgggctcaagcaatcctcccacctcagcctcccaagtagctgggaccacaggcacatgccaccatgcctgcctgttttttgtatttttagtagagacgtgggtctcaccatgttgcccaggctgatcttgaactgctgagctcaagcgatctgcccaccttggcctctcaaattgctgggattacaggtgtgagcaatgtgcctggttagagtattctttttttttttttttttgatatggatcctcatactgtcgcctaggctggagggcagtggcatgatctctgctcattgcaacctccgccgcccaagcgattctcctgcctcagcctcccgagtagctgggattaggggcatgtgccactatgcctggctaattttttgtatttttagtagagacagggtttccccatttggccaggctggtctcgaactcctgacctcgtgatccgcctgcctcagcctcccaaagtgctagaattataggcgtgagccactgcgcccggccatggtcagagtattcttaaaaaacatcaaaatgagtatagggtgggaagggactaacatttttttttattctattcaatttatttatttatttatttattttttattatactttaagttttagggtacatgtgcacaacgtgctggttagttacatatgtatacatgtgccatgttggtgtgctgcacccattaactcatcatttaaccttaggtatatctcctaatgctatccctcccccctcccctaaccccacaacaggccctggtgtgtgatgttccccttcctgtgtccatgtgttctcattgttcaattcccatctgtgagtgagaacatgcggcgtttggttttttgtccttgcgatagtttgctgagaatgatggtttccagcttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacagtaaacatacgtgtgcatgtgtctgtatagcagcatgttttataatcctttgggtatatacccagtaatgggattgctgggtcaaatggtatttctagttctagatccctgaggaatcgccacactgacttccacagtggttgaactagtttacattcccaccaacagtgtaaaagtattcctatttcttcacatcctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatgaggttgtttgatttttttcttgtaaacttgtttgagttcattgtagattctggatgttagccctttgtcagatgagtagattgcaaaaattttctcccattctgtaggttgcctgttcactctgatggtagttttttttttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatagttgtagatatgtggcgttatttctgagggttctgttctgttctattggtctatatctctgttttggtaccagtaccatgctgttttggttactgtagccttgtagcatcgcttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcaggatattgattcttcctacccatgagcatggaatgttcttccatttgtttgtatcctcttttatttccttgagcagtggtttgtagttctcctttacgaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctgtcagcttaaggagattttgggctgagatgatggggttttctagatatacaatcatgtcgtccgcaaacagggacaatttgacttcctcttttcctaattgaataccctttatttccttctcctgcctaattgccttggccagaacttccaacactatgttgaataggagtggtgagagagggcatccctgtcttgtgccagttttcaaagggaatgcttccagtttttgcctattcagtatgatattgactgtgggtttgccatagatagctcttattattttgagatacgtcccatcaatacctaatttattgagagtttttagcatgaagggttgttgaattttgtcaaaggccttttctgcatctattaagataatcatgtggtttttgtccttggttctgtttatatgctcgattacgtttattgatttgcgtatgttgaaccagccttgcatcccagggatgaagcccacttgatcatggtggataagctttttgatgtgctgctggattcagtttcccagtattttattgagaatttttgcatggatgttcatcagggatattggtctaaaattctctttttttgttgtgtctctgtcaggctttggtatcaagatgatgctggcctcataaaatgagttagggaggattccctctttttctactgattggaatagtttcagaaggaatggtaccagctcctccttgtacctctggcagaatttggctgtgaatccatctggtcctggaccttttttggttggtaagctattaattattgcctcaatttcagatcctgttattggtctattcagagattcaactccttcctggtttagtcttgggagggtgtatgtgtcgaggagtttatccatttcttctagattttctagtttatttgcgtagaggtgtttatagtattctatgctggtaatttgtatttctgtgggatcggtggtgatatcccctttatcattttttattgcatctatttgattcttctctctttttttctttattagtcttgctagcagtctatcaattttgttgatcttttcaaaaaatcagctcctggattcattgatttttttgaagggtttttgtgtctctatttccttcagttctgctctgatcttagttatttcttgccttctgctagcttttgaatgtgtttgctcttgcttctctagttcttttaattgtgatgttagggtgtcaattttagatatttcctgctttctcttgtgggaatttcgtgctataaatttccctctacacactgctttaaatgtgtcccagagatgctgatatgttctgtctttgttctcattggtttcaaagaacatctttatttctgccttcatttcgttatgtacccagtagtcattcaggagcaggttgtttagtttccaagtagttgagcggttttgagtgagtttcttaatcctgagttctagtttgattgcactgtggtctgagagacagaccacattataacaaacttgttataatttctgttcttttacatttcctgaggagtgctttacttccaagtatgtggtcaattttggaataggtgtggtgtggtgctgaaaagaatgtatgttctgttgatttggggtggagggttctgtagatgtctattaggtcttcttggtgcacagctgagttcaattcctgtatatccttgttaactttctgtctcgttgatctgtctaatgttgacagtggggtgttaaagtctcccattatcaggctgggtgcggtggctcacgcctgtaatcccagcactttgggaggctgaagtgggcggatcacgaggtcaggagatagagaccatcctggctaacagggtgaaacccaatctctactaaaaaataaaaataattagccaggtatggtggtgggcacctgtagtcccagctacttgggaggctgaggcaggagaatggcgtgaacccgggaggcagagcttgcagtgagccaagatcgcgccactgcactccagtctgggtgacagagcgagattctgttccccccccaaaaaaagtctcccattatattgtgtgggagtctaagtctctttataggtctctgaggacttgctttatgaatctgggtgctcctgtattgggtgcatatatatttacgatagttagctcttcttgttgaattgatacctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactaatgggtcttgactctttatccaatttgccagtctgtatcttttaattggagcatttagcccatttacatttaaagttaatatggttatgtgtgaatttaatcctgtcattatgatgttagctggttattttgctcgttagttgatgcagtttcttcctagccttgatagtctttacaatttggcatgtttttgcagtggctggtaccggttgttcctttccatgtttagtgcttccttcaggagttcttttagggcaggcctagtggtgacagaatctctcagcatttgcttgtctgtaaagtattttatttctccttcagttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgccctttctctctggctgcccttaacattttttccttcatttcaactttggtgaatctgacaattacaattatgtgtcttggagttgctcttcttgaggagtatctttgtggcgttctctgtatttcctgaatttgaatgttggcctgccttgctagattggggaaattctcctggataatatcctgcagaatgttttccaacttggttccattctccccgtcactttcaggtacaccaatcagatgtagatttggtcttttcacatagtcccatatttcttagaggctttgttcgtttctttgtattcttttttctctaaacttctcttctcgcttcatttcattcatttgaccttccatcactgataccctttcttccagttgatcgaattggctactgaggcttgtgcattcgtcatgtagttctcatgccttggttttcagctccatcaggtcctttaaggacttctctgcattggttattctagttagccattcgtctaattttttttcaaggtttttaacttctttgccatgggttcaaacttcctcctttagctcggagtagtttgatcatctgaagccttctcctctcaactcgtcaaagtcattctccatccagctttgttccattgctggtgaggagctgtgttcctttggaggaggagaggcgctctgatttttagagtttccagtttttctgctctgttttttccccatctttgtggttttatctacctttggtctttgatgatggtgacgtacagatggcgttttggtgtgtatgtcctttctgtttgttagttttccttctaacagacaggaccctcagcttcaggtctgttggagtttgctggaggtccactccagaccctgtttgcctgggtatcagcagcagaggctgcagaacagcggatattggtgaacagcaaatgctgctgcctgatcgttcctctggaagttttatctcagaggagtacccggccgtgtgaggtgtcagtctgcccctgctgggggggtgcctcccagttaggctactcggggaccagggacccacttgaggaggcagtctgtcagttctcagatctccagctgcgtgctgggagaaccactactgtctttaaagctgccagggacatttaagtctgcagaggttttggctgccttttgtttggctatgtcctgcccccagaggtggaatctacagaggcaggcaggcctccttgaactttggtgggctccacctagttggagcttcctggccgctttgtttacctactcaagcctcagcaatggcaggcgcccctcccccagcctcactgccaccttgcagtttgatctcagactgatgtgctagcaattagcgaggctccgtgggtgtaggaccctccgagccaggtgcgggatataatctcctggtgtgccatttgctaagaccgttggaaaagcgtagtattatggtgggagtgacccgattttccaggtgccgtctgtcacccctttctttgactaggaaagggaattccctgaccccttgtacttcccgggtgaggcgatgccttgccctgctttggctcatgctcggtgtgctgcacccactgtcctgcacccactttctgacactcctcagtgagatgaacccggtacctcagttggaaatgcagaaatcacctgtcttctgcgtccctcacgctgggagctgtagactggagctgttcctattcggccatcttggctccaccccccgggactaacattttttgaatgcctgctatgtgcctgatgctgtaaagtgcttcctccatggtttctaatttaatgctctcaacaatattgtgaggtagagacataatcccagctttactgataatgatgctgagcctcagacaggccctgaaagtcttagaagttcacataactgctaagaggcagaatttccatgcaaatcccaggagtgcctggctccaaacccacgatcctcttacttcaccatgatggtccgcttgctgaatggctcagcaaagcagccaacttaccatctccttcaccttgaaaaagccctgattccatgaaaggcaaagaggagagagcctggagaaggtcagtggtcagcactagaggtgtgccaaaggacagcagtacctgtcaggagagcagtacagatgtgtgcatgcatgtacacacacatgcacacacatgttaatatacatacatacacacacacacacacaccaccagtgctctaactctcaaatctaacactactacccaggagtgtttgttgggaggtagagtaggcaggccacccacaaccgccccaaacactgagtcattttcaattatgtgcgtgaactagttggcaagatcagtcagaaagtctgcagtcacaataatcgtggcctaagagggtctctactgatggcctgtgctagtggttctcagcgtattgttcctggaccaggaacatcagtagtacttggaccttgttagaggtgcaaattctttgctcttctccctactccctgcatcccagactaaataagaaactctgggggtaaagcccaataagttgtgttttaacaagtgctcagggtggttctgctgcagggaattactgactgatggatgcatggattccgttatccacccattcatttattcctgcattttttcatccaaccctaaaagaggtaaccaaaacagaaacaatcctatgtgtaagcatggtatatcttctctgcttcacccagcaaagtgatatgaaaatgcattgcaaatgtgtttacaaataaagctcctttcccatcagggaggattcctagcgctgtcagcaaaaaaatgaagaatgctccaagataggcctcgagagctattgtgaaacagctgctgatggaatgaaatctgcttgctgtgcctgataccaggctgggagtgtcataagatccttttcacaacttgctcccacactcagtcttgtcagtgcaaaacaggcatgtccaaggggtcaccagattagtacagcacaagactccactgggaaagaccttggtggattcagcaaatgaatgactccctgggagtcagactctcagccacacccaagacatgtcctcctcttttcttatacaccttctttatccatgagcacacccaaacccaacatccttggtcctgaccatgggggactttagctgctgtgtaaagctcctgaaactcaagggtagaagagatatgttttaagaatacacagggtttgcctcaaccttgaccaaaagcaggtctgcctgttgggagggcccatcagagacagcaacccatccttgcccccagttttccacccctgtaaaggcttcccagacctctctctacctctatcatcctgtctccaggccactgtcccctggcaaagacactgctatggtttggatgatggtgacccctccaaaatttgtgttgaaatataatccccaattggccgggtgtggtggctcatgcctgtaatcccagcactttgggaggctgaggcgggcggatcacgaggtcaggagatcgagaccatcctggctaactcggtgaaactctgtctctattaaaatacaaaaaatcagaagggcgtggtggcaggcacctatagttccagctactttggaggctgaggcaggagaatggcatgaacccaggaggcagagcttgcagtgagccgagatcgtgccactgcacttcagcctgggtgacagagtgagactccgtctcaaaaaaaaaaaaaaaaaaaagaaatataatccccaattaaacagtattaaaaggtgtagccttttggaggccacatcttttaagtcatgagggctctgccctcataaatggaattagcacccttataacaaggctcaaggttgaagggagcactctcttgcccttctgtcccttccatcatgtgaagacacagtgctcctcctctctggacaatgcagcaacaaggtgccatcttggaagcagagggcggccctcatcagacgccaatcctaccagcaccatgatttcggacttcacagcctccagaactatgagaaataagtttttattctttataaattatgcagtctaagtatttttgttatttagtttttatttcataatcataaacttaactgcaatacagctagacatggaaggaataaggaaaatatggaacccaaaaaactgcagtgggagtacccagattagaggatactgtgagcaaatgagttggagtgctcttctgagctacagaaggaatgatctggtggttaaaacacaagtcacatttattagagttatctacagtccgcaatagttcttgtcggtcttgccattcctgctcccaaagtgctccatggcttccacgatattcatgccctgtttccccttgccaaagatcacatggttgccatccaaccactcaatcttggcagtgcagatgaaaaactaggaaccatttgcgttgggtccagcattttccatgaacaagatgccaggacctgtatgcttcaggatgaagttctcatcatcaaatttctccccatagttggaattgccatcaactattaaggcatgtgaagtcaccaccctgacacataaactctgggataattctgtgaaagcaggaacccttataactaaattatttctctccagtgctcagagcatgaaaattttctgctgtctttggaactttgtctacaaacagttagaagatgcagcccaagggctcaccatgggtggcgatgttgaagaacatggtgagtttgactgtggctggtggcagaggtctctgtgtgtcagcggcatctgcaaagcagcccaatcttaagtattttgttataacagcacatacagactaagacaacttccttgaccaaactttaattgggctcatctgagcattctgcttaaccagggcatgaccttggtctgccattaggcaagaatcctgctaagttattttagagagaatctccgcaccttttatatctaattacctttgatatctgatcaagtttcttattccccacccttgatgtctaagtccttggcttccctctaccaagaatcctattagacaattttagcaagaatccccctacccttgatatctccttttgttaattctctatccactgaccttttcattcttctcattggcaatacatctatagctatctttgctgaatttggagtaagtgcaatctctctcccctcttgtaatagtcttgaataaagtcttccttaccatttcaataagtgccagaataatttctctgttatctgcagctttattaaggtataagtgacaaataaatattgtgtatattgaaggtatacgctgtgatgatttgatatatgtatacagtgtgaaatatttaccagaatcaagttaattacaacctcatcacctcacatagttgccattttgtgtgtgtgtgtgtggtaaaggcacttaagatctactctcttagcaaatttcaaatatacaataattattattgactataatcactatgactaccaacagaaggacatactgcttgccctggctgtctccttccccttcctccaagctcttggaataacattgctgtcaaaaagttgtgggtaaaatgcagatgtgtatatgtacacagctttatttgagattaaatttaggagttaaaattttagaaagtaagacatgatgtattttaaccataataagtaagatcttgaaataagaggaaggacacaaaagataacatttctacatcattatcatttgaaatattactattcttggcattctcatgccaaagtatctccaaccccagccaatggtatatttgctatcctggattttctgacattatttgtagagtactgggctggcagtcaaagctccccccactatggataaagaccacattttcagtcctgttttccaggaactctgtgctcttggcaaatggcacaattttctgctccctcaaaagactccttcatttttccacaatgctttagcatgctagggttgaattttcacagggcttggccttggcacacacatgatgtcaccacatcctcagatcaaacccatgaaagagcattggtacccagttttagaggagaagaaaacaagtcttgaggagagtgtcttgccagccttgtctttgttaaagaaacagattgctggagattagagaagggtggaggaataaagttgttttggtgttaaattacaaaatgaatataaatcttgaatacatgttcaagttacataaatggtgtttattattatgaagtctcgttagcagcactggcataaatttgcccctccagctctatttccagattcctttcccctacccctatctattttgtggagggaggatgtgaggagggaaaagaggagagggtgggtatgtggcgcctaccctggggaggagagttctgtacttgggtggtagctacaaagttggatgtagttaaagtgagccacctttccccatgcagattcccttgcttggcacgtagtaggcacaaacacatgtttatttccaattgacagttgtctttattgattgtgattacattttttccttctgttgcagaagaccttactgctgatagcaccatcttcaaatttgtggaagcttatgtgagttggataggaaaatttcctacatataatgttggctcttccatttgtttctaatttagtatttctcaattgatattttttttgt

SEQ ID NO: 4791 - DNA, 115171 bp, human
tcgggaaatggcggccgcggccgggctggggcttcagcgggaggcagcagaggggaagtggtcagcgtggcgaatgacggaaggtggcgagggagaggaagaggggtcgggtgtccgcggagctccaagagggaagacaatcgctttgccaaacacggcagggcatctggaaaggcctgggaacctcacccgccctcccaggcccttcgggctcttttcggtcccattaggaggagggggagggcggcaggtgggaccgggcacaggcctagtcgtgcgacaggagaagggaaggaagggccggccccagctgggtcctccttgcgtctggcctgtgccggacgcccccgactccgagtgatctcgggccggtccccgggggagtccagcttctcgcgccaggggagttctcagccccagggcagtccagggattaggcggaagggggcacgcagccacctggccggggcagggggagctgcgaggagccttttttttttttttttttcctgcgcagagccccttgcgtgacacacagtaggcgctcaatacatgtttattttcagttgagtgttgcttcagcttttatggcttgtgataaatccttatccttctgttctagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaattagtgcttggtggttctcaaattatttcacgcgtggtagttttgatttttgcttttccagtgaggctgtacctttcatccttaggcaaatatgatggctttcaaaagcagctatggggtgggaactgggagtggctgcaaatgggcatggagcgtcttttagagataacgaaaatgtcccaacttagattgtggtgatagttcgcacaactctataaattactaaaaactattgaatttgcacttgaaaagggggagaactttatgaaatataaattataactcaaagaagctcttaaaatgcctatggaataataagtaaagagtagtggggatatgatctattttgtggggagactagcagcaaagtaagacataaagataaagaaacatacactggcctgaggaagtaacaaagtctctttgagcaaactttggacaggctcctctcagctttcttttcaactacaccttgtccttgggccctgtcctcggcctgcctagcccagttttagcaagagtcctgctgagtaactccctcacccttgatacctgatcaccttgtcctgccttgagcgagaatcctgtttagtcagttgagcaagaatccccctacccttgatatctctctccccttaggaattttctttctactgactccctcactctgctgcttgactgtaaatccacacttgtcctagttgtctttggattgagcttagttctatactgaagtctcttttcctctattataatagtactcaaaatatggctttactgcttttgactagtatctggctctgtttcccattggcggaaggcactctcagacagtgcttctagtagtatatattagcatgacctgccagggtacaattctttttaaaaagaccaccaattggctggatgcagtggctcacgcctgtaatcccagcactctgggaggccgaggcgggtggatcaggtcaggagttcgagacgagcctggccaacatggtgaaacccccatctctactagaaatacaaaaattagctgggcatggtggtgtgcgcctgtaatcccagctacttgggaggctgaggcaggagaatcacttgaatgcaggaggcggaggttgcaatgagccaagattgtgccactgcactccagcttgggtgacagagtgggcctccgtctcaaaaaaaaacaaaaacaaaaaaaagaccaccaatttattgccaggcattgtactgggtgctgaggaaatttgaggaaaaacacctattaagttcctgtcctcaaggagctcatagtacagtggggagccaagtagcaagcaaatagccatgcaagtgtataattgcaatgaggacaagtatcatgaaaaggagggtacatggtgcaatgagagcctataaaataggggtattcgactagtcaaggtggtcaggaattgcttcaaagaagcagttattgagctgagagttaaaggaagaatagtggctaattagattggaggtgagagttggaggagctggtttgaggctatgtgttcagagatggcatggtgagtaaaagagactgaatgaaagtggctggagttcaacaggcagttgggacagcagtgtgttgggtcagggcatgcagggccttacaagccatcttaagccattcagtctatatcctaagagccattggaagccctgtgggatggggagaacgaatcagatttgtctttgaaaatattgccctgggggccaggcacagtggctcatgcctgtaatcccagcactttgggaggctgaggcaggtggatcacctgaggtcgggcattcgagaccagcctggccaaccaacatggtgaaaccccgtctctactaaaaatacaaaaagttagccgggcatggtggtgcatgcttgtaatcccagctactcgggagggtgaggcaggagaatcgcttgaacccgggaggcagaggttgtggtgagctgagatcgcgccattgcacaccagcctgggcaacaagagcaaaactctgtctcaaaaaaaaaaaaaaaaaaaaagaaaggaaaagaaaatattgccctggctacagtgtggataaaggattgggaaggagtcagaatgtatggagagttttattagaagccatttcaacaatctagagtagaggtaatagtagcttgtactacaatagccatggtttacatggaggggattggtatattttagggtttcttaggaggtaaaatctgcaggacttggcaatggattggaattgggagggagggagtgtgatattgtgaagtacacatttagtctttagtttgttttgtgctgctataacaatacccgatagtgggtaatttataaacagaaatttattgccttacagttctggaagataggaagtctaaggttaaggtgtgggcaggtttggtgtctggtgaggccattctctttttccaagatggtccctgcacacactgtgtcctccagaggggaggaaggctagatcatgacatggcagaagacagaaagaagggccaagagatagagcaagaggagaccgatcttgcccttttataatggcattaatcccacctgtgagggtagagccctcatggcttaatcacctcttaaaagtctcacctcttaatactattactgcaaccgcccagtgggttcaccttgcctgctgcctagacagagatttatcaagacaggagagttgaaatgaagaaagagtaattcacacacagccggctgtgcaggagaccagagttttgttattacttaaatcagtctcccagagcatttgggggatcagttattattattattattattattattattattattattatttgagacagagtcttgctctgttgcccaggctggagtgcaatgatgtgatttcggctcactgcaacctctgcctcccgggttcaagcgattctcctgcctcagcctcccgagtagctgggattacaggtgcccgccactatgccaggccaatttttgtattttttagtagagatggggtttcaccatgttggccaggctggtctcgaactcctgacttcaggtgatccacccgcctcagcctcccaaagtgctgggattacaggcgtgagccaccgtgcctggctgggatcagagtttttaaagataacttggtgggtaggggcttgggaagtacggagtgctgatcagtcaggttggagatggaatcatagggggtcgaagtgagtctttcttgcagttttgtgttctgggtgggatggcagaactggttgagccagattacaggtctgggtggtgtcagctgctccatcgagttcagggtctgaaaagtatctcaggcactgatcttaggtttcacaatagtgatgttatccccaggagcaatttggggaggttcagactcttggagccagaggctgcatgacccctaaactgtaatttctaatcttgtagctaatttgttagtcctgcacaggcagactagtccccaggaaagaaacgcctatgatcaattttgtttcagaatcaaaccacaaactgaattccttcccaaagttagtttgacctatgcccaggaatgaacaaggacagcttaaaggttagaagcaaggtggagtcggttaggtctgatttctttcactgtcataatttcctcagttataattttgcaaaggtgatttcattacaatggcaattaaatttttcatttttattttatttatatatatatatttttgagacggagtctcactatgttgcccagattggagtgcagtggcgcaatcttggctcagtgcaacctctacctcctgggctcaagcgattctcctgcctcagcctcccgagtagctgggattacaggcgcccaccaccatgcccagctaatctttgtatttttactagagacaatgtttcaccatgttggccaggctggtcttgaactcctgacctcaggcgatccactggcctcggccccccaaagtgctgggattacaggcgtgagccaccatgcccatggggcaattaaattttaacatgagttttggagaagacaaacattcaaaccatggtagtcttcatcctcattttcgcgaattacagcttttaaaacccttagaatctctgaggtgatgagagtatcttttgccctgggtggtggctcacgcttgtaatcccagcactttgggaggccgaggtgggcggatcaccaggggtcaggagtttgagaccagcctgaccaacatcgtgaaaccccatctctactaagaatacacaattagccgggcatggtgacacatgcctgtaatcccagctacttgggacgctgaggcaggagaatcgcttgaacctgggaggcggaggttgcagtgagctgagatcacgccattgcactctagcctgggcaacaagagtgaaactccgtctcaaaaaaataaaaataaaaataaaaataaaaaagtatcttttgcatgctaatgagataactggtggctgaggctcctaggtagatttaggacgggggcgctggtcaaggcaggattagagagttgagactttttcaccacacccccagcctctggggaagggagaggagctgaaggttaaattgactagcagtggccaatgatgtaatcaatcatgcctacatagtaaagcctctattttatttattttttatttttatattttgagatggagtctcactcttgttgcccaggctggagtataatggcgtgatcttgcctcactgcaacctccatctcacgggttcaagcgattctcctgcctcagcctcccaagtagctgggattacaggcatgcaccaccacgcctggcaaattttgtatttttagtagagacagggttttgccatgttggtggggctggtctcgaactcctgaccttatgtgatccacccacctcggcctcccaaagtgctgggattacaggcgtgagccaccgtgcctggctgtaaagtctataaaaacccgaaagaattgggtttggagagcttctggatagcgaacacatggaggtacctagagggtgctgtgcttgtagggggcatggaagcttggtgccccttatcctgtaccttgtcctatgtgattgttccatctggctgtccatctatatgctttgtaatatcctttataataaacctgtaaacatgtttttcagagttctgtgaccctctctagcaaattaatcaaacccaaggggagggtcatgggaaccctgatttacagtgggtcagtcagaagcatagcttacaacctggcatctgaagtggagagcagtcttgtgagcctgagctctcaaactgtgggatctgacactatctccaggtaggtagtaacagaactgaattcaattagaggacatccagctggtgtccactgcaaaactgattgcttgatgtatgggaaaattctcccatacatctggggctacagaagcattctatattaaatagagagtataggaaaatccacattttgtttactcccccctgtatcttacagtgagagtgagcggtcaagggtgacttctcagtttctggcttgtacaactggatgtttggagtaacagcattaagaagcaggacctttaagatcacattgaatactaagttcaggtatgaggactgtgagtttagtcttagacatactgtgtttgacgtgcctttgagaacacccaagagaatataggtagttggatggatggatctagagctcagaaggggcctatatattggatatataaattgtgtgctatatggatatagttgataattcaagccatgtgtggggataaggttgtctaggccaaagagtatcagagtgagaatgcaggagatcaaagaaggaggcttgagaaactccagtatttcatgtggagtacaggagagtcagcctgcaaaggagactgggaaacagcagccagggaggtttaaaagaaagttaggagggacttgtgtcattgaagccaaagaaagaaactgtttcaagatgtagggaatggactgttaacaatgtccattgctgctcagaggtcaaataagatgtggactggtaaatatgtgttgcatttaagaatatggaggcattggtgtcctggatggatctattttcatggaatgacggggcagaaatctagaatggaacagattggagtgtggttagcagagagaggaaggcactttttttttttttttttgagacggagtttcactcttgttgcccaagctggagtgcaatggtgcgatctcggctcactgcaacttccgcctcccgggttcaagcaattttcctgcctcagcctcccgagtagctgggattacaggcgcacaccaccatgcccgactaattttttgtatttttagtagaaacggggtttcaccatgttagccaggctggtcttgaactccttacctcaggtgatccgcctacctcagcctcccaaagtgctgggattacaggtgtgaggtactgcgcccagccggtaggcaagtaatggaaacaaagaatataggcagctatttgaagcactttggctgtgaagggcatggaaaagtcagggtagaagcaggagcgagactacgggtcaagagaggcctttcaaattatttatttatttatttttttgagacagggtctcacgctgttgcccaggctggagtgcagtggcacaatcacagctcactgcagccttgatttcttgggctcaggcgattctcccacttcagtcttctgagtagctgggattagaggtgcgcacaccaccacgctgggctaatttttgcattttttgtagacatggggtcttgccatgttacccagtctggtctcgaattccagggctcaagcaatctgcctgccttagcctcccaaagtgctgggattacagtcttgagctgctgcacccagccaaggactttttttaatggagaaattttgtggatgtgtaaagtttacaattaagggtctgtagggagtgagtggttaaaaatacagcagagagatgggataaatcatagagtacgtttgctaagagagaggagcatctggaatcgaaagcataggtggaggaattagtgttcactaaaaggcaagagcatctctgtcttaattgaggaactaactgctggtaggatgtgtgcaggtatagttggtttatgtttggtgttaggaagatgagagacaacttccttctaaaggctcccccaaccccgttattttttctgtaaatgagggtgtggtcatctgcatgtagagataataaggaggaggagttggaaggctgaagagaatggagaaggttcaatgagttgtaagggtgagagcaggttgtaggttgaccagagaaaaatagaaggactgctgagaaatgttgatggctcacttctggttgttgatggtaaatttactatgagccaagctttatttttttctaagtgcttctctaagtgttctagtgttttatttaatccccaaagcagctctatgaggtaggtattattattatcacccccttgtcacagatggtaaaatggaggtacagcaaagttgtgtcatttgtttaaggacaaagagctagctaggtttggagccaggtagtctgactccaaagcccatgatcttaaccatcactctaaaatatatcctaaaaataggtcctgatcatactttttcattgataaacatagatctgtataatcacatttaaggactacattgttggttttatgcttgatggtctgtccagtgacttttccagaaactctctagctgcattcttgagtcaatgccaaatctcagaaaggagagagcttatttgaaccctatgttacaagagttttgatttcctttccttctagtttgttgtattttccaattttctatagagagtacatataattttcattttgtggggaaaaataaagttaacatctctaaaataaaaaagccaggctaggaagggaatagaggtctaagactcagtgtttttaaaatctactatagctaaacatgtttactttgtgtcttagtttattttgtgttactataacagaatatctgagactgtgtaatttataaagaaaagaggtttatttagaggtttatttagttttgcaggctgggaagttcaagggcatggcctcagcttctggtgagagctttctctctctcattttttttttcaagacagagtcttgctctgtcgcccaggctggagtgcaatggtgcaatcttggctcactgcaacctccacctcccaggttcaagcaattctcctgcctcagcctcccacgtagctgggactacaggtgcacgccactgtgtctggctaattttttttgtagttttagtagagatggggttacaccatgttggccaggctggtctcgaactcctgatcacaggtgatccgcctgccttggcctcctaaagtgctgggattacaggcatgagccactgtgcctggccgagagctttcttgacacatcataacatggcagagaaggtcaaaggggaagtgaacacatgtgaagaggcaaaaccttaggggcatcctggctttataaaatcctactcttgtgggaactaattcattcctaagggaatgaatccagttttgaaagagggagaactcactcactaccatgagaatggcaccaagccaatcatgaggtatctgctctcatgacccaaacaccttccattaggccccacctcccaacatgccacattagggatcaaatttcaacatgagttttggtgaggacaaactatatccaaagtatagcattctataattcaacaactccattcctagaaatttcatttcaagagaaattaaagcttatgtgtatataaagacgtgtacaccggtgttcttaccaattttatttataattgccccaaactggaaacagacaaatgtgcataaacaagtgagtagataaactgtggtatatccatacaagggaatactatttagcaataaaaaggaataaatccttcatatatacaccaacatggacaaatctcaaaataattatgctgggtgaaagatgtcagattaaaaaagagagtatatactgtattattacatttatatagtataggaaatgcaaattaatatacattttcagtactcagatcagtggttacctctgaaggtgaggattaactaggaaggggcatgaaggaatcttatgaggtgatggaggtgttttatatcttggtctagttacaccagtgtatacatatcaatttcattaagctgtgcatttgagatttatgcatgttactctgtgaatgttgtatctcagtaaaaaggttaagacaaagtttagctccttttgtcagtctcctttccctttcctttgaccctttcctatatttctttttctctccatctctctctgttctctactttttgtatccatttgagagagagttgatggcacatcaggcactcatgctgactctacacttaaccctgccaattaaatgttcacatcccttcaaatgtacagtttattcaggaaagtaggattgaagaagtctgtggttaaagaatagctcttaggagtgaacatttcttccttttcccttgcacttgaattagatacgtatctttgggccttcacttctgttttggtatttcttttcctttttttttttttttttttttgagacagagcctttgtcacccaggcgggagtgcagtggtgtgatcacagctcactgcagcctcaacctttcgggctcaggcaatcctcctgtctcagcctcccgagtggcatgtgccaccatgcccggctaattttttaagttatttgtagagatggggtctccctatgttgcccagactggtctcgaactcctgggctcaaggaatcctcctgcctcagcctcccaaattgctggaatcacaggcatgagccgctgtgcccagctctgttgtggtatttctttaacagctggcgttataggaatcagacagacttgcctttgaatccctgctgcaccacttgttagctatttgatcctgatacaatgacttatcttctatgatcctcagttttctcatccagagcatgggtataataatgcctacctcctagattgtcttttttttttttttttttttgaggtggagtttcgctcttgtcgtccaggctggagtgcaatgacgtgatcttggctcactgcaaccttagtctcctgggttcaagtgattctccaacctcagcctcccgagtagctgggactacaggcatgcgccaccatgcctggctaatttttgtatttttagtagagatggggtttcaccatgttggccaggctggtctcaaactcctgacctcaggtgatctgcccacctcggcctcccaaagtgttgggattacaggtgtgagccaccgcgcccagccaggtgtcttaagaattaaatgagataatattggtaaagcactttgcctgccatcgagaggccacttaatttcggatggctttcttatttcccaagactgtgaacttgtgacttttgactcttggatgacatctagccctgctccattagacattaaataactctttttattgttactagtataacaactagggagaggacttatacttgcaatatgacttttaaatctgtccttgggctcacataacatgtttcttaccatataagaatggagaaggcttttttattggcttccacgacattcctgggtggttggtttgagacagctagttgttgctatcctgttacagaggtgaaggcaggagaggcatcttgacttcaccaagatcttatatcttgtatggtgataggtctggcactgacaaatgttctatatctttccttgagcagatgtaataagacattacagacatctgagtaaataaaaatagggttatggtttttcttcctaccccagactctaccagatgactcattcctactacatagaaataacagtgaatgtcaaccataacacagatgcctatttatttctctccttactgactcatttttgagagctttttagctagttgtgctatttagttgatctcaaagttatcttctgcagggaagtttcggtggaaagaacactgatatttgttgaatgattgctctgtgtcaaacatagggctagttgtttttaaggaggtctaatcaactctgaggtaataaacactattggattttggagaatgagaaaacttgattgtggaaaacagaaccagtttctagaccgccactcagctaatatgtgacagaagaaatatcccttatccccatccattgattttatttctttttgcttcagatttaaagagcatgtgacaaatagtctagcctttctctgtcttagccccattgcagtcactgttaaccaactatcttcttgaaaccaaaatgactcagcctaaccacagaagcaaatcaaacactgatggcccataatctccagacaaggctttaaccaaacctctgtctatccatctatccatttgttcattcattcaacagatatttgttgagcattgactctttgctagacattgtgtgaggggttgttgttgatgctagagtagaactatttatcttccacaaatgaggcatgaccctgctagggacctgtgttactagcaagcagctttgaggtcagggtaggaagtgaggatagagtctcagaaggaagaaaataaatatttacagagtgtggattgtatccaattcatgggatcctgggaagttcattaactgccaggaggattcctagttctcagctctaggcagcagcatcttggaaggcttctctgaaggtggactccgaaggatctaaggctcagatgttcccctttcagcttctgccctccattccctgcactcctaggtcttagatggtcatgcttgtctctgtatccaaaacctacttttggcacatttttatttcctcccaagctgtaagaacagcttgttcacttgggaaggtcatacttcaaagtggaactctgccatttcagaggggctttgaagatacacagtatacctgggggagtgaaggagttgggtgtcactccccaggataaggcaaacaaaaacaagaacagacacatatcactatgacttaggtatggattaaagattaactgcaccttgcacagaggtggctctcaatacgttttctgcattccatcttgagcatcattttttggctctattgtattctacacttccttcccagaagtttacagtgtttcctaattcactgataagcagttaaaaaattgccccacatttggtattacaaaagtttatgcaccacgtttcttttttttttgagacagagtctcgctctgttgcccaggctggagtgcagtggcacaatctcggctccctgcaagctctgccttccgggttcatgccattctcctgcctcagcctcccgagtagctgggactacaggcacccgccaccatgcccggctaattttttgtatttttaatagagatggggtttcattgtgttagccaggatggtcttgatctcctgaccttgtgatctgcccgcctcagcctcccaaagtgctgggattataggcgtgagccaccacgcctggcctgcaccatgtttcttaaaggcatatatagtgattgttttcttttctagttttgctaatagtgtatgttttgctgatcatgtagtaacagtgttttctttataaatttatgaaagtacaaaaagatatatatgaaaacaaatgagccagaggaaattactattgatattctggcatattttcctccagcttttcaacaaatcttgaatatataatcttgaattactcttttaaaaattgacattataacatacgcattttcctgttttcatttaaaaattcccataaacatctgtttcaaggtttgcatattctcccttttatggctgtaggcaggttcactgaatgacaacttagccttgaagccctctatgaccactcttgaccctatatgtcttgcctctggaatggactgaagcgaagatgagtcccgtgttctctatcccttaatagtggtttcatgtgagggagttctgctttgctggatagggtgaatcacatcctccaagacaccagccttctaaaacatttaccatatagggctgggcgcggtggctcatgcctgtaatcccagcactttgggaggctgaggcagtaggatcacgaagtcaggagttcaagtctagtctgaccaatatggtgaaaccccgtctctactggaaatacagaaattagccaggtgtggtagtgctcgcctgtagtcctagctactcgggaggctgaggcaggagaatcgcttgaacctgggaggcagaggttgcagtgagccgagatcctgcccctgcactccagcctggcaacagagcgagattctgtctcaaaaaaaaccccatgtatatacatatatacgtatatatacacatatatatgtatacatatatgtatatacacatatatacgtatatatatgtgtatatacacgtatatatgtatacatatatgtatatacacatatacacatgtatgtatacatatatatgtatatacgtgtatatatgtatacatatgtgtatatatacacgtatatatacacatatgtatacgtgtgtatatatacgtgtatatacacacacgtatacatacgtatatatatacgtgtatatatacacacatgtatacatatgtgtatatgtgtatatatacacacatgtatacatatatgtgtatatatacacatatgtatacatacacgtgtatatacacacatatgtatacatacacgtgtatatatacacatatgtatacatatatgtgtatacatacgcacgtatacacatgtatgtatacatatttgtatatatactcacatatacacatatgtatacatacatgtgtatatacacgcacacatacacatatatgtgcatatacgcacatatatacatatatgtacacatatgtatatatacacacatatatacatatatgtacacatgtacgtacacatatacatatatgtacctatatgtacatatatacttacatataaacatatgtacatatatgtacatatatacttacatataaacatatgtacatatatgtacatatatacatacatataaacatatatacctgtatgtgtatatgtatacacacacacacacgtacttaggacagtgttgtgcaataggaaggtcttcataaaaacatttttgggaaaagtacttaatttctctgagtctgagtttcctcatctgtcacatctgtttcctcatctgatccatgtggattgcaggtacaacaagtcactgggttgttgtggtgattaaatgagaaaatgtctataaatgaatcccagtgcttggcacatagaatgtgctccataaatgtcagtcattattactattccctgataaatgacgtagtgtggagaagtatcgattgagtacagaaaacaggacagggcttggaagtggtgattaatgatgatgcaaaaaaaaattattctcctgcaaaacctgcttgctttatgcacatttggactattggggcagagaccatggtgggcctgtgggctttgaaaccacctcagaaaacattttgccttagaacattcttttctatttttatttttaaaaagaagatatcttgggtggttatccacttttttttttttttccgagatggggtctggctctgtcgcccaggctggagtgcaatggcttgatcttggctcactgcaacctctgtcctctgggctcaagcaatcctcccacctcagcctcccaagtagctgggaccacaggcacatgccaccatgcctgcctgttttttgtatttttagtagagacgtgggtctcaccatgttgcccaggctgatcttgaactgctgagctcaagcgatctgcccaccttggcctctcaaattgctgggattacaggtgtgagcaatgtgcctggttagagtattctttttttttttttttttgatatggatcctcatactgtcgcctaggctggagggcagtggcatgatctctgctcattgcaacctccgccgcccaagcgattctcctgcctcagcctcccgagtagctgggattaggggcatgtgccactatgcctggctaattttttgtatttttagtagagacagggtttccccatttggccaggctggtctcgaactcctgacctcgtgatccgcctgcctcagcctcccaaagtgctagaattataggcgtgagccactgcgcccggccatggtcagagtattcttaaaaaacatcaaaatgagtatagggtgggaagggactaacatttttttttattctattcaatttatttatttatttatttattttttattatactttaagttttagggtacatgtgcacaacgtgctggttagttacatatgtatacatgtgccatgttggtgtgctgcacccattaactcatcatttaaccttaggtatatctcctaatgctatccctcccccctcccctaaccccacaacaggccctggtgtgtgatgttccccttcctgtgtccatgtgttctcattgttcaattcccatctgtgagtgagaacatgcggcgtttggttttttgtccttgcgatagtttgctgagaatgatggtttccagcttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacagtaaacatacgtgtgcatgtgtctgtatagcagcatgttttataatcctttgggtatatacccagtaatgggattgctgggtcaaatggtatttctagttctagatccctgaggaatcgccacactgacttccacagtggttgaactagtttacattcccaccaacagtgtaaaagtattcctatttcttcacatcctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatgaggttgtttgatttttttcttgtaaacttgtttgagttcattgtagattctggatgttagccctttgtcagatgagtagattgcaaaaattttctcccattctgtaggttgcctgttcactctgatggtagttttttttttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatagttgtagatatgtggcgttatttctgagggttctgttctgttctattggtctatatctctgttttggtaccagtaccatgctgttttggttactgtagccttgtagcatcgcttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcaggatattgattcttcctacccatgagcatggaatgttcttccatttgtttgtatcctcttttatttccttgagcagtggtttgtagttctcctttacgaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctgtcagcttaaggagattttgggctgagatgatggggttttctagatatacaatcatgtcgtccgcaaacagggacaatttgacttcctcttttcctaattgaataccctttatttccttctcctgcctaattgccttggccagaacttccaacactatgttgaataggagtggtgagagagggcatccctgtcttgtgccagttttcaaagggaatgcttccagtttttgcctattcagtatgatattgactgtgggtttgccatagatagctcttattattttgagatacgtcccatcaatacctaatttattgagagtttttagcatgaagggttgttgaattttgtcaaaggccttttctgcatctattaagataatcatgtggtttttgtccttggttctgtttatatgctcgattacgtttattgatttgcgtatgttgaaccagccttgcatcccagggatgaagcccacttgatcatggtggataagctttttgatgtgctgctggattcagtttcccagtattttattgagaatttttgcatggatgttcatcagggatattggtctaaaattctctttttttgttgtgtctctgtcaggctttggtatcaagatgatgctggcctcataaaatgagttagggaggattccctctttttctactgattggaatagtttcagaaggaatggtaccagctcctccttgtacctctggcagaatttggctgtgaatccatctggtcctggaccttttttggttggtaagctattaattattgcctcaatttcagatcctgttattggtctattcagagattcaactccttcctggtttagtcttgggagggtgtatgtgtcgaggagtttatccatttcttctagattttctagtttatttgcgtagaggtgtttatagtattctatgctggtaatttgtatttctgtgggatcggtggtgatatcccctttatcattttttattgcatctatttgattcttctctctttttttctttattagtcttgctagcagtctatcaattttgttgatcttttcaaaaaatcagctcctggattcattgatttttttgaagggtttttgtgtctctatttccttcagttctgctctgatcttagttatttcttgccttctgctagcttttgaatgtgtttgctcttgcttctctagttcttttaattgtgatgttagggtgtcaattttagatatttcctgctttctcttgtgggaatttcgtgctataaatttccctctacacactgctttaaatgtgtcccagagatgctgatatgttctgtctttgttctcattggtttcaaagaacatctttatttctgccttcatttcgttatgtacccagtagtcattcaggagcaggttgtttagtttccaagtagttgagcggttttgagtgagtttcttaatcctgagttctagtttgattgcactgtggtctgagagacagaccacattataacaaacttgttataatttctgttcttttacatttcctgaggagtgctttacttccaagtatgtggtcaattttggaataggtgtggtgtggtgctgaaaagaatgtatgttctgttgatttggggtggagggttctgtagatgtctattaggtcttcttggtgcacagctgagttcaattcctgtatatccttgttaactttctgtctcgttgatctgtctaatgttgacagtggggtgttaaagtctcccattatcaggctgggtgcggtggctcacgcctgtaatcccagcactttgggaggctgaagtgggcggatcacgaggtcaggagatagagaccatcctggctaacagggtgaaacccaatctctactaaaaaataaaaataattagccaggtatggtggtgggcacctgtagtcccagctacttgggaggctgaggcaggagaatggcgtgaacccgggaggcagagcttgcagtgagccaagatcgcgccactgcactccagtctgggtgacagagcgagattctgttccccccccaaaaaaagtctcccattatattgtgtgggagtctaagtctctttataggtctctgaggacttgctttatgaatctgggtgctcctgtattgggtgcatatatatttacgatagttagctcttcttgttgaattgatacctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactaatgggtcttgactctttatccaatttgccagtctgtatcttttaattggagcatttagcccatttacatttaaagttaatatggttatgtgtgaatttaatcctgtcattatgatgttagctggttattttgctcgttagttgatgcagtttcttcctagccttgatagtctttacaatttggcatgtttttgcagtggctggtaccggttgttcctttccatgtttagtgcttccttcaggagttcttttagggcaggcctagtggtgacagaatctctcagcatttgcttgtctgtaaagtattttatttctccttcagttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgccctttctctctggctgcccttaacattttttccttcatttcaactttggtgaatctgacaattacaattatgtgtcttggagttgctcttcttgaggagtatctttgtggcgttctctgtatttcctgaatttgaatgttggcctgccttgctagattggggaaattctcctggataatatcctgcagaatgttttccaacttggttccattctccccgtcactttcaggtacaccaatcagatgtagatttggtcttttcacatagtcccatatttcttagaggctttgttcgtttctttgtattcttttttctctaaacttctcttctcgcttcatttcattcatttgaccttccatcactgataccctttcttccagttgatcgaattggctactgaggcttgtgcattcgtcatgtagttctcatgccttggttttcagctccatcaggtcctttaaggacttctctgcattggttattctagttagccattcgtctaattttttttcaaggtttttaacttctttgccatgggttcaaacttcctcctttagctcggagtagtttgatcatctgaagccttctcctctcaactcgtcaaagtcattctccatccagctttgttccattgctggtgaggagctgtgttcctttggaggaggagaggcgctctgatttttagagtttccagtttttctgctctgttttttccccatctttgtggttttatctacctttggtctttgatgatggtgacgtacagatggcgttttggtgtgtatgtcctttctgtttgttagttttccttctaacagacaggaccctcagcttcaggtctgttggagtttgctggaggtccactccagaccctgtttgcctgggtatcagcagcagaggctgcagaacagcggatattggtgaacagcaaatgctgctgcctgatcgttcctctggaagttttatctcagaggagtacccggccgtgtgaggtgtcagtctgcccctgctgggggggtgcctcccagttaggctactcggggaccagggacccacttgaggaggcagtctgtcagttctcagatctccagctgcgtgctgggagaaccactactgtctttaaagctgccagggacatttaagtctgcagaggttttggctgccttttgtttggctatgtcctgcccccagaggtggaatctacagaggcaggcaggcctccttgaactttggtgggctccacctagttggagcttcctggccgctttgtttacctactcaagcctcagcaatggcaggcgcccctcccccagcctcactgccaccttgcagtttgatctcagactgatgtgctagcaattagcgaggctccgtgggtgtaggaccctccgagccaggtgcgggatataatctcctggtgtgccatttgctaagaccgttggaaaagcgtagtattatggtgggagtgacccgattttccaggtgccgtctgtcacccctttctttgactaggaaagggaattccctgaccccttgtacttcccgggtgaggcgatgccttgccctgctttggctcatgctcggtgtgctgcacccactgtcctgcacccactttctgacactcctcagtgagatgaacccggtacctcagttggaaatgcagaaatcacctgtcttctgcgtccctcacgctgggagctgtagactggagctgttcctattcggccatcttggctccaccccccgggactaacattttttgaatgcctgctatgtgcctgatgctgtaaagtgcttcctccatggtttctaatttaatgctctcaacaatattgtgaggtagagacataatcccagctttactgataatgatgctgagcctcagacaggccctgaaagtcttagaagttcacataactgctaagaggcagaatttccatgcaaatcccaggagtgcctggctccaaacccacgatcctcttacttcaccatgatggtccgcttgctgaatggctcagcaaagcagccaacttaccatctccttcaccttgaaaaagccctgattccatgaaaggcaaagaggagagagcctggagaaggtcagtggtcagcactagaggtgtgccaaaggacagcagtacctgtcaggagagcagtacagatgtgtgcatgcatgtacacacacatgcacacacatgttaatatacatacatacacacacacacacacaccaccagtgctctaactctcaaatctaacactactacccaggagtgtttgttgggaggtagagtaggcaggccacccacaaccgccccaaacactgagtcattttcaattatgtgcgtgaactagttggcaagatcagtcagaaagtctgcagtcacaataatcgtggcctaagagggtctctactgatggcctgtgctagtggttctcagcgtattgttcctggaccaggaacatcagtagtacttggaccttgttagaggtgcaaattctttgctcttctccctactccctgcatcccagactaaataagaaactctgggggtaaagcccaataagttgtgttttaacaagtgctcagggtggttctgctgcagggaattactgactgatggatgcatggattccgttatccacccattcatttattcctgcattttttcatccaaccctaaaagaggtaaccaaaacagaaacaatcctatgtgtaagcatggtatatcttctctgcttcacccagcaaagtgatatgaaaatgcattgcaaatgtgtttacaaataaagctcctttcccatcagggaggattcctagcgctgtcagcaaaaaaatgaagaatgctccaagataggcctcgagagctattgtgaaacagctgctgatggaatgaaatctgcttgctgtgcctgataccaggctgggagtgtcataagatccttttcacaacttgctcccacactcagtcttgtcagtgcaaaacaggcatgtccaaggggtcaccagattagtacagcacaagactccactgggaaagaccttggtggattcagcaaatgaatgactccctgggagtcagactctcagccacacccaagacatgtcctcctcttttcttatacaccttctttatccatgagcacacccaaacccaacatccttggtcctgaccatgggggactttagctgctgtgtaaagctcctgaaactcaagggtagaagagatatgttttaagaatacacagggtttgcctcaaccttgaccaaaagcaggtctgcctgttgggagggcccatcagagacagcaacccatccttgcccccagttttccacccctgtaaaggcttcccagacctctctctacctctatcatcctgtctccaggccactgtcccctggcaaagacactgctatggtttggatgatggtgacccctccaaaatttgtgttgaaatataatccccaattggccgggtgtggtggctcatgcctgtaatcccagcactttgggaggctgaggcgggcggatcacgaggtcaggagatcgagaccatcctggctaactcggtgaaactctgtctctattaaaatacaaaaaatcagaagggcgtggtggcaggcacctatagttccagctactttggaggctgaggcaggagaatggcatgaacccaggaggcagagcttgcagtgagccgagatcgtgccactgcacttcagcctgggtgacagagtgagactccgtctcaaaaaaaaaaaaaaaaaaaagaaatataatccccaattaaacagtattaaaaggtgtagccttttggaggccacatcttttaagtcatgagggctctgccctcataaatggaattagcacccttataacaaggctcaaggttgaagggagcactctcttgcccttctgtcccttccatcatgtgaagacacagtgctcctcctctctggacaatgcagcaacaaggtgccatcttggaagcagagggcggccctcatcagacgccaatcctaccagcaccatgatttcggacttcacagcctccagaactatgagaaataagtttttattctttataaattatgcagtctaagtatttttgttatttagtttttatttcataatcataaacttaactgcaatacagctagacatggaaggaataaggaaaatatggaacccaaaaaactgcagtgggagtacccagattagaggatactgtgagcaaatgagttggagtgctcttctgagctacagaaggaatgatctggtggttaaaacacaagtcacatttattagagttatctacagtccgcaatagttcttgtcggtcttgccattcctgctcccaaagtgctccatggcttccacgatattcatgccctgtttccccttgccaaagatcacatggttgccatccaaccactcaatcttggcagtgcagatgaaaaactaggaaccatttgcgttgggtccagcattttccatgaacaagatgccaggacctgtatgcttcaggatgaagttctcatcatcaaatttctccccatagttggaattgccatcaactattaaggcatgtgaagtcaccaccctgacacataaactctgggataattctgtgaaagcaggaacccttataactaaattatttctctccagtgctcagagcatgaaaattttctgctgtctttggaactttgtctacaaacagttagaagatgcagcccaagggctcaccatgggtggcgatgttgaagaacatggtgagtttgactgtggctggtggcagaggtctctgtgtgtcagcggcatctgcaaagcagcccaatcttaagtattttgttataacagcacatacagactaagacaacttccttgaccaaactttaattgggctcatctgagcattctgcttaaccagggcatgaccttggtctgccattaggcaagaatcctgctaagttattttagagagaatctccgcaccttttatatctaattacctttgatatctgatcaagtttcttattccccacccttgatgtctaagtccttggcttccctctaccaagaatcctattagacaattttagcaagaatccccctacccttgatatctccttttgttaattctctatccactgaccttttcattcttctcattggcaatacatctatagctatctttgctgaatttggagtaagtgcaatctctctcccctcttgtaatagtcttgaataaagtcttccttaccatttcaataagtgccagaataatttctctgttatctgcagctttattaaggtataagtgacaaataaatattgtgtatattgaaggtatacgctgtgatgatttgatatatgtatacagtgtgaaatatttaccagaatcaagttaattacaacctcatcacctcacatagttgccattttgtgtgtgtgtgtgtggtaaaggcacttaagatctactctcttagcaaatttcaaatatacaataattattattgactataatcactatgactaccaacagaaggacatactgcttgccctggctgtctccttccccttcctccaagctcttggaataacattgctgtcaaaaagttgtgggtaaaatgcagatgtgtatatgtacacagctttatttgagattaaatttaggagttaaaattttagaaagtaagacatgatgtattttaaccataataagtaagatcttgaaataagaggaaggacacaaaagataacatttctacatcattatcatttgaaatattactattcttggcattctcatgccaaagtatctccaaccccagccaatggtatatttgctatcctggattttctgacattatttgtagagtactgggctggcagtcaaagctccccccactatggataaagaccacattttcagtcctgttttccaggaactctgtgctcttggcaaatggcacaattttctgctccctcaaaagactccttcatttttccacaatgctttagcatgctagggttgaattttcacagggcttggccttggcacacacatgatgtcaccacatcctcagatcaaacccatgaaagagcattggtacccagttttagaggagaagaaaacaagtcttgaggagagtgtcttgccagccttgtctttgttaaagaaacagattgctggagattagagaagggtggaggaataaagttgttttggtgttaaattacaaaatgaatataaatcttgaatacatgttcaagttacataaatggtgtttattattatgaagtctcgttagcagcactggcataaatttgcccctccagctctatttccagattcctttcccctacccctatctattttgtggagggaggatgtgaggagggaaaagaggagagggtgggtatgtggcgcctaccctggggaggagagttctgtacttgggtggtagctacaaagttggatgtagttaaagtgagccacctttccccatgcagattcccttgcttggcacgtagtaggcacaaacacatgtttatttccaattgacagttgtctttattgattgtgattacattttttccttctgttgcagaagaccttactgctgatagcaccatcttcaaatttgtggaagcttatgtgagttggataggaaaatttcctacatataatgttggctcttccatttgtttctaatttagtatttctcaattgatattttttttgttgattagaaaaacaattttacttcctgcagaatatactgaaaatgtttttacttcctctttgaaaccactttttatttcttcagccaccctgatttcttgtctcttggttttttttgagcagatttttagtccctttttaatggtctcataagcaagtgtgttcattttgctcattcaattttacctgtaagctatgctagggccttcatagaagctgactgagtaatacatgaagaaggatagacatgtggtatgtactgtgggcagaataaaacaagggggcataaaatggcaacttcctacattgcttccactagtatctgtagtggtatatatctgccctttgaagggagcaatttgtttgaaagtcccttatgagttatctgctgttgcataacaacttacccccgaacttagctgcttaaaataataattttttattatctcacatatttctgagtgtcaggaatctaggagtggttaagttgggtgttttgggcttcaggtctctcatgaggttgcaattaagaggttggctgaggccagttgtggcagctcacacctgtaatcccagcactttgggatgctgaggcgggtggatcatgaggtcagaagttcaagaccagcctggccaagatggtgaaaccccatctctactaaaactacaaaaattagccgggcgtggtggcaggcacctataatcccagctacttgtgaggctgaggtagaagaatcgcttgaacccgggcagcagaggttgcagtgagccaagattgcgccactgcactccagcctaggcgacagagtgagactccgtctcaaaaaaaaaaaaaagtcagctgaaactgaagtcatttgaaggtttcgggttaaaggatccacttccaagacagttcacagagctgtttgcaagatgcttcagttcctcatcatgtgggtctctttacagggctgcttgagtgtactcatgatatggctgctggcttcctccagagggaatgatctgaaagagagagagataaaggagaaagctgtgatgtcttttatgatctagtcacacactgttgtttttgccagattctattagttggaagcatgtcactaagtccaacccatacttaaggggaaggaaattagcatacacttttagagggaataatatcaaataattgtggacatctttttaaatcaccacagtccccttaattttacctacctattacctattcattcaacaaatattttctgaacatgcctacttagtgctgggtcctatgctaaatccaaaggatccagtggtgagaaaataacagtaagaacatcgactaaaccctgacaaggtttctcttgatgtctacagacagagtgggaggtgaagaggtggtcagacaacaatctgataatgaaacaaacaaatgtgaagagaagacgcttagatgatgttggccctgaattggaaaaggctgtctgggagctcggctgcccacccagcattcagtgtctgctacctcctgtctgttatgcttgtgtctggttttttcaagttttaattttttttttaattcttagtttttgtgggtacatagtaggtgtatatatttatgggttacatgagatgttttgatacaggcatgcaatatgtaataatcacctcatggagaatggggtacccatcacatcaagcatttatcctttgtgttacaaacggtccagttagactcttttagttattattaaaatgtacaattaaattatttttgactatagtcaccctgttgtgctagcaaatactaggtcttattcattctttttaactattttattgtacctcttaaccattcccacttcctccccaccacacactatccttcccagcctctggtaaccatccttctactctatctccatgagcttaattgttttaatttttagctcccacaaataagtgagaacatgcgatatttgtttttctgtgcgtggcttatttcatttaacataatcacctccaggtccatccatgttgttgcaaaagacaggatctcattctttttatggctgaagagtactccattgcgtataagtaccacattttctttatccactcatctgttgatggacacttaggttgcttccaaatcttagctattgtaaatagcactgcaataaacatgggagtacagatatatgttcaatatactgattttctttcttttgattatgtgcccagaagtgggattgctagatcgcatagtagctctgtttttacttttgtgagggaatctccaaactattctccatagtggttgtactaatttacattcccaccaacagtgtacaagggttcccttttctccacatccttgccagcatttgttattgcctgtcttttggttaaaagccagtttaactggggtataactggggtaagatggtatctcattgtaggttttttgttttgttttgttttttgttcttttgagatgaagccccactctgttgcccaagctggagtgcagtggagtgatcttggcttgctgcaacctccacctcccgggttcaagcgattctcctgcctcagcctcccaagtagctgggactacaggcacatgccaccatgcccggctaatttttgtatttttaggagagacggggtttcactttgttggccaggttggtcttgaactcctgacctcgtgatctgcccaccttggcctcccaccaaagtgctgggattacaggcgagagccaccgcgcctggccgtttttttcttttctttccttttttttttttttttttttacagagtcttgctctgtcacccaggctggagtgcagtggtgcaatcttggctcgctgcaacctctgcctcccaggttcaagcaattcttgtgcctcacccacgcagctgggattacaggtgttcaccatcacactagctaatttctgtatttttagtagagacgggttttgccatgttggccaggctggtctggaactcctgacctcaagcgatctgcccgcctcagcctcccaaagtgctgggattacaggcgtgagccacctcgcctgggtcaaatcaccattataactttcttgtactttgatattggtaccttctctaggtttcagaagttctctgttattatccctttgaataaactttctaccccatctctttttctacctcctcgttaaggtcaataacagatttgctcttttgagactattttctagatcctgtagttgtgcttcatttatttaaattcttttttcttttgtctcctctgactgtattttcaaataccctgtcttcaagctcactaatcctttcttcttcatcatccattctgctattaagggactctgatgtattcttcagtatgccaattgcatttttcagctccagaatttctgcttgattcttttaaattatttccatttctttgttacatttatctggtagaattctgcattccttctctgtgttatcttgaatttctttgaatttcctcaatacagctattttgaattctctgtctaaaagatagcatgtctctttttctccagaattggtgcctggtgccttatttattttgtacggtgaggtcgtgtttccctagatggtcttgatgcttgtggatgttcatctgtgtctgggcattgaagagctaggtatttattgtattatttacagtctgggcttatttgtacctatctttcttgggaaggctttccaggtattcaaagggacttggacgttgtgatctaagctgtatgcattaggaggcaccccaagcccagtaacactacggttcttgcagacccatagaggtactaccttggtggtcttggataagatctggaagagttctctggattacccggaagagactctttttctcttccctttctttctctgagacaaacagagtctctttctttctctctgtttttgtgctgagcctcctggagctggaggttaagcgagaaaagtacacctgtggccagcaccactgataattttctgggtcagacctgaagccagcacagcactgggtcttgcccaaggccctctgtaaccactacctggctaccacctatgtttgctcaaagccctagggctctacaatcaataggtggcaaagccagttaggcttgtgtctttcttccctccccttcccacaggcagataagcctcactccatggtcactgccaccacaggcccatggggaagtacttccagattaccatcaatgttcacttaaggcccaagagctgtgcagtcagcttgtagtgagtgcttccatgcctgaggctcgtccttcagggcagtgaactcccctctggcccagggcaggtctagaaatgctgtccatgaggcaaggcctggaatcagggaccccaagaacccactttgtgctctacttccaaggaccaagctcatacctaaggtgcaagagaaagttctctttacttttccctccgcttttctcaaacagaagcagtttttcaccatagccaccagagttggcaatgtgctgggtctctcctgaaaccagcacatctcagaacccaaggcccatagtgtactttctggatattgctgctggttattcagggatccagggctcttcagtcagcaggtgatgggtcctgccaggacagagtctttccctttaagggagtggggtcccttttggcccacagtgtgtatagaaatgtcatttgggagctaaggcctggaataggggcctcacaactctgcccagcaccctatcctactgtgtctgagctggtatccaagatgtaagacagtcttctttactcttccctctcctctacagaaatggaaggaagagtctcttttaaagctgtgagctgtctgcctggggttggaggtggggtggcataagcgttcacttagcctccctggcttgtgtctcaataggtcatgtgaccctcagtcttctggctctgggcccagttcagcactaggacatgcctaggaattgcagtccttttggcctagactgtctttcaagtttatttagggccccagaacactttagcctgtggtgataaggcttgtcagaactcaagttctgaccactgggatgggtaatttccctctggctagggatggtctaaatgctccctctgtgggcaggcatcaactgagttcagcctggttttgctttctgctataacggggcatcactgagttcaatgctaagtctcatgatcactgcattctccttctcccaagcacatgaattttttctccatgtcatgtggctgctgccaggagatgggggaagggtgccatcagcaattcatgatggtctttcctaccctcttcagtgcctctttcagggatatgaagttaaaaccaggtactgtgagtactcacctgatttttagttcttttgaaggtgcttttttgtgtagttgataaatttggtgttcctgttggggagatgatcagtggagccttctatccagccatcttgccctgtccttctccatgtatgtattttgataggtgaagacacaagaccaaaatgtgcttcccagagagcatgaatgaatacaatacttactctggacactgatctagaaagtccaaagaatgaaaggaaatcctaccaattcatttaaaaagaatgtaatgttttttctctcaactctatgtcaacgtaaaataaccaaaaagatcacaatctagtttgggagtttattcaagtgaaaaggttgaggacagcctgcccagtaagcacagatttcaaagaattcaagtcagtgttccaaagagtagaagttcaagatcgtttatatagataaggttcagggaagtttaacagaatttcattgtctttctatggaagccttaatgtataattacaatgatacaattggtcaaggtggtctttttcttttaggaaaggtatatttaacattccacaccgaatatataactgtcatggggtacctatttgggggtgttatccgatctgagttagatgcaggacaataaaggaggcagttggtctataacaaagatcagtgattggaagggggaagtctagtctctgatctttcctagttatttacagagcaagaacaatgaggaagagagttaatctgtgatctaagaagcagaagttataaatacgtgctacatgactcagatcacagttacatctctcttaagtctttaaatgtcttgaggcttccaactgcttttatattttattttcacaactagtcccttcagaacaactcattatatcatgcagaaatagtattaagttatcacacaatgtacaaaatattatttattttcctttttgctgttaaatttccataggttctccatgacatggttgggctggtttttttggtttgtttgtttttgtttttgtttttgtttttgttttttgagacagggtttcactctgtcgcctaggctggagtgcagtggtgcagtctcagctcaccgcaatctctgtctcccaagttcaagtgattctccttcctcagcctcctgagtagctgggattataggcgcacaccaccacacccggctaatttttgtatttttagtagagatggggtttcgctatgttggccaggctggtctcaaactcctgaccttaagggatctacccacctcggcctcccaaagtgctggaattatagatatgagccaccacgcccagctgggctgtttgttttattattattattattattattttcagaaaggaggtagtagggagggagaaaacttatattgaatgagcaattacaacacaccggttactttatataggttttcttatttaattctcattaccaccctgaaaataaagtactattatcaccattttacagataaggagatgaacagttagaacggttagatagttttttttaggatcactcaactagtgagtggaacaggaaggactcaaatacagactttgtttaactgtggtgtttattatggtgcttcattttgagatggtgtgctttcaagatttagggttacattgatttgagcttgctaagtcatagagttcttttttgattaaatgccaaaatgaatataaatctttaccatattttcatgacacaaaaatagtatttgttattatgaagggccactaacattaatactctgagctccatggctctaagcccctaattgctcagtttcagtaaatttgatgttctatagacccatgcttctcaaactgaaatgtgtaaacatatcacctggggtatgtggttaaaatgcaggctcttatccaataggtcccgagtggggcctaagctgcatgtctaacaggctttcacgtggtgctgatactgcttgtcttcatatcatagtttgagtagcaagactgtggagtagcaagacttaaatactcttgaaattcccggggtacttccagcagtctaagaatttgtagacacggacaaggatggctagctgtgctagaactctgaggcttctggtcacagctgttttacaggggttctcctctacaccagaactctgcttgtggtaccacttctatctcctgtatatgagtggatttgctatgccaaatccacatagcagagtggaaatctgctatgccaggtattactggatctgcatgctattgcagtcccttgatgttaattataagaggatgatgagcaatggcagcctagaagagggtgaatcagagaggcaagtacgataggtatctggtgcttgatagggaggagagagagggagcctggaccatgaagagttttagaaagtttaaacttccctatatacctctgtaagccagatgttgagtaaggttttagagatatagcgtcgttaccctcaagaaaatttcagcctggaggggaagactgatgagtaacctacagaacatagtgatgggtgtaagtttagggcattatcagagcctagagcagagccatttaactcacacttgggatggggtggggaaggagcagggcagtggtgtgttggaaaatgtttaacaatcagttctctgaaaaaaataaaagctctgatctgtagtgtttgttgacttccatggtgtaaatacttccatcatggccaatttctttttttttttttatttttttttgagatggagtctcgctctgtcgcccaggctggagtgcagtggtgtgatcttggctcactgcaagctccgcctcctgggttcacaccattctcctgcctcagcctcccgagtagctgggactataggtgcctgccaccacgcccagctatttgtttttgtatttttttttttttcagtagagatggggtttcaccatgttagccaggatggtctcgatctcctgacctcgtgatccgcccacctcggcctcccaaagtgctgggattacaggcatgagccactgcgcctggctcatcatggccaatttcaaggtactatcttgatgtcactgaacaaagaattgggaagagatgttcataattggctcttgtaagtcaggccaagctgactctaagcacaccattgaggtagtgaatccttcccaaagtaaatgtctttgtcaattcgggctgtcataacaaagtactatagactggatggcttgtaaacaacaagagtttattcctcacgtttctggagtctaagatcagggtgccagcatggttgggctctggtgagggccctcttcccagggttgcagacttctaacttttcactgtactctcacatggtagaaagagggcaaactagctttctggcctcttcttataaaggcattaattccattcatgagggctccatgcttattacctaattacctctcaaagtccccacctcctaatattatcacactgggcattgggatttcaacatatggattttttgagggaaggagggacccatttagaccattgcagtgggaaagaagagatttgaaggataagcagaagttagcccatcaaatgtagaggacaaatgagaggattccaggtagaaggatggcaggtgcaaatgacccaaggtaataggaaacatggtgctttggcagtaagttatgaattagagtggaagtggacagtcctaagtctccaagtaggcaaacatataattacagaacacatttaattttactctcttttctgatcccattattgcatttgacaaatcatttccatcaaactagaccaatgctgcatttatgtctgtgatgagcttaaatcttagtaaggacattaattgaatctatttgtattttttttcaaggtattaagcaaatcatcttattagatactccacaaagagcatatttgtagtaagtaatgacacaattttagattattaccactaaactcttttaaagataatttataatctacttaagaattacacagctatcacaatgtgcatcttaacaaaggcacaaaaagataatgctcctccatggtttattatgattttgtgtataaaaagaagatatatgaatactttttttctcaactttcattttagtttcgggggtacatgtgcagatttgtcacatgggtaattgtatgttgctgaggtttggtgtataaatcatctcaccacccagattgtgagcacagtacttgataggtagtttttcaaccctcgcccccctccagcctcccgtctagtattccccagtgtctgttgttttcatctttatgtccatgtgcacccaatgtttagctcccacttataagtcagaatacgagacatacggttttctgtttctgcattagtttgcttaggattatggcctccagctgcattggtgttgctgcaaagaacatgatctcattctttttttaatggctgtgtagtattccattgtgaatatgtaccacattttctttatccagtccaccgttggtgggcgggtacccgggttgattccatgtctgctattgtgaatagtgctgcaatgaacatatgggtgtgtgtgtctttttggtagaacaatttattttcctttggatatatactcagtaatggggtgctgagttaaatggtcgttcaactctagttctttgagaaatctttaaagtgttctccatagtggctgaactaatttacattcccaccaacagtatataagtgttcccttttctctgcagcctcatcaacacctgtttttcttttttttgctttttaacaaaagccattttgactggtatgagatggtattttattgtggttttcatttgcatttccctgatgattagtgatgatgagcacttcttcatctatttgctggcctcataggtgtcttcttttgagaagtatcgttcatgtcctttgcccatttttaatggtgttgttttttgattgttgaattttaaagtactatagatatgtacttctttttattgtgggctttttcaaacctacataaaaatagagtggtaatgaattgccatattctcaccaaccaacttcaacaattataaactcataactaatctcatttaatccttctaaagagtttggacttaaaaatccataacttcagtgttattattattcatcaaacaattaacaatattccttaacattattaaatcttcatttagtgttctaattttcttaattgtctaatttttcctttataatttgtttaaaacaggattcaaagtccatatattgtattttattgactttttaaaagtttctcttaatttgttggttctctgtgtatttttattttaaataaaatatttattttaaataaaattttattttaaaattattttattttactttgaggtggggatttgctatgttgtccaggctggtcttgaacttctgggttcaagtgatccttctgcctcagcctcccaagtagctgggattacaggcatatgctactacacccagctttattttaaaattatttcaacttctttgttgaagaaaacaggttaatttagcctgtaaaattttccacattctggaatttactgactgcatccctgtggtattgattaacatattattttgcttcctagtttcctgtaaactggtagatctagaggcttgttctgattcaggtttgattttctggaaggaatatttcataaatgttatttgtatttctttcaagaggtacatactatctgactgaaggtctcttttttgtgatgttagtggccatcaatggtcatagcctagattcattatttccttagggatttgtaagatggtgatattcaatttctgtaattccttcttcatttattggttaaaaaaaatggccttggtgcagtggctcacgcctgtatccccaacagaggcagaggtgggcagatcacctgaggccaggagtttgagaccagcctggccaacatggagaaaccccatctctactaaaaatacaaagttagctgggtgtggtggtgcatgcctgtaatcccagctactcgggaggctgaggcagagaatcacttgaacctgggaggtggaggctgcagtgagccgagatcgcgccattgcactccagcctgggcaacaaagcgagactgcatctcaaaaacaaacaaacaaaaccccccaaacccccctttttttagacggagtctcactctgttgcccaggctgaagtgcagtggcaccatcttggctcactgaaacctctgccttctgggttcaagtgattctgctgcctcagcctcctgagtagctgggactacaggtgtgcaccaccatgcccggctattttttgtattttagtagagacggggtttcaccacgttggccaggctggtatcgaactcctgacctcaggtgatccaccagcttcggcctcccaaagtgttgggattacaggcatgagccactgtgcctggcctaaaaaaccttctgtaaatggaaaatttctctcaataactggtcactgtgaggggcaatttggattcccttagcatcatccttcaaaggtggccaataaagattttttttttgatattattatgaattcttagagttttaacatattcgatgtgtttcgactcatcagttcattgcagttgttatttttaatgatgctcaaatttgctgttgcaatcattttcaagttggctcctgaatgcttttgacacaaccccactagcccttgatagctttcttgcttggtaactagtaaaataacataaataagtaatttgaaatatttatgacatgttaactgcaaaattgtgattctaaattaccatttcgttatgcttcatataaaaggaaataaaaactacccttgcatccaacctatggaatgttaagttgacacataagacagtcaaagcttcctttaattcaatatccccccccttttttttttttgagacggagtgcaatggcatgatctcgactcactgcaacctctgcctcccgggttcaagcaattctcgtgtctcagcctcccgagtagctgtgattacaggtgcccgcccccacgctcggctaatttttgtgtttttagtagagatgggattttatcatgttggccaggctggtctcgaactcctgaactcaggtgatctgcctgccttggcctcccaaagtgctgggattacaggcgtaagccactgtgcccggctcaatatcctactaatttctagctttactaggcagctagtgcatgatttcctcttctaaacaaagcattgatacttatctaaataaaataaaataaaattaaattaaaattaaaatggaatggggtagaatctcttccttcttaaaaatgtgttcctggagctactaaaaaacttggattttcaaagtccttgataaaaaccattcccctatattgtagaagggaagtattgggacccctgataatactgggtataagtatgctattcagacttggcttctttccatcctgctgcatcagaggctagattcaccttttatgttttccctttcttgccgtctttagtgtcttgtttagccactccagtgagtttcccttttgcccttcctttcccttatgtttgtactttttactgaaggtttatccttttactttgccttttgtttatgatttaattttaacttctgcaggagcgggtttgaacgactaccttcagatcttctcttgggctctttatttagcacctctttagctgaattgactttcttcttataaatcttggcaatggctgcagtggggagggcaggtgcctgggtgcctgggtgcctgtgggccttcatgaagctggcctacctgtatatttcatttcttgcttatatttccagatgctatctataatagctatgtagctataatagctataatagctctatgcagtttatatcaaagtcttctctttatgtgagaaagaaagcagggtaggccaggactaacatttggtgaagtccttttatgtgtcagacattctttgttgattttctcattatgttctctcttagagtcacgtaaaaggtaaaataaggagggcaagaaaacacaattttttaaaaaaggaaatggcatagggattttctatttttttctcagccccagaaggtaattactcttacaatgcagaagtatcaccagatactatctgcacaggttttcccattttttcctcacaccactgtggtaaagcagggggatctgtcacctccactgaggagactgaggctcacaagaggtgataacatataaaactctatcagtcatttatggagtggagcagaggctctcaaagttcagcatgcatcatctgtaggtgtataaacactaattgctgggccctgcccctagagtttctgattcagaccatctggttgagacccaaagatatgcatttctaagaagttcccaggtaatgctgatgctactgctctagggaccacagtctgagaaccactggtctggctaatagacaaacaaacaaataaacaaaacagcatttattctttacaaggtacatagagaattgcactgagctgagaggattggtggaagtacatggcctggagtcaaagcaaaggggtcagagtttgcagtgtacctaggcccatgacctgggccattcactcaggcagggggtgacactatatcattctcctaaaatgtaagggaaccagtcactggtccttagaacagctcatgtgggcattggtgatttcatcacatctcttaccctggggagcctggtgggtgagggattaagctccaggctcctgggatctcccttgatcttagctattcaaattacttattattaaatccgtaattcagatcagggtataggaagttaggagatgttaagtaaatcagggaaactgtcttataaatgcttacttagtagtgaaacctggaattactgtaaagctttccccatggtgtctggaatccaccagggctctaagtactccaatctgtctgggtaactgatgctgggcggggtatggcttagttttttaaaatagtgaaatatattacttttaaattatattattactgaaaaatttaaaacacagtatatggcaaaaaatcagtaaagcttgtctaaaatgatgacagcaaatatttgcaaactattaatatatgtagctaattcttatgatataggaaaccttcccagtagccaatataaagagatggacaaatgaggtaagcagcctctaagacggtgatctcaatgagccatgcctcctagtgttcatgcacttgcataatccctatccttgagtgtgggctggtagttaggagaggcttaaataatgaaaactgaaattactctaaagcttttctgtttgaagcctccagggctctgaatgctctgatttccctgggtgctggcacttgatgctctccatggtattgctcaatttctgttataatgaactgttttatttatttatttgtacaatataacataatatttaccattttaatcattttaaagtgtacagctcagtggcattaagtactctcacattgttgtgcaaccatcaccactgtccatctccagaactcttcattttgaataaaactctatacccattaaatgataacttcctattctctttttccttagactctggcaaccaccatccttttctctgtataaatttgactactctgggtagttcatacaagtggaatcataccacttttgtccttttgtgtctggcttctttcacttagcataatgttttcagagtcagcatgtaacagactttccttcctttttaaggctgaataatattccattgtatggatatactgtcttttgtttatccattcatccattcgtggacatttggtggtttctaccttttggctattgtgagtaatgctgctgtgagcatgggtgtgcaaatatatgttcaagtctctgtttcatttcttttggctatatacccagaagtggaatttctggatcatatggtaattctatgcctaatattttgaggaactgccatactattttccacagtggctgcaccattttatattcctacaagcaatacacaagggttccaatttctccacatcctcaccaacacttaactattttctccctctctttttttttaaataatagccatcctaatgggtgtgatttattatttatttttaaaactaaactttattttgtaataattttaaatttacaaagctgtataattttaattaacattattgaaaaatttaaaacactgtgtattgcagaaaaaaaggtaaaagttatgtgaaaagtagagagaatatttgcaaactaatggggcttatatttgtgatatgttaggcagacttactgaccaacagtgggtcaatgatgtcaaaagaaaattcactgaaagagcaatatttatgtcagtaaacattgctaatgaaatatcaatgaaagtcagagatatattaagtgaaataggaaaattgcagaagaatatgttatgactacagttttgaagaatatgtgtattttgtatattttatgtaaatatttttctttatatgtagctatacagtagtaaattacgtgtacataaacacatctggagaacatgcacctattttcagtgaaaatctttgggtcagggagtgagagtcaggcagatgaaaggataaatttaatttacacatacacctttttggcttgtttgaaattttgtaatcaggaacatttattaagataaaaatttgtaggccggcgcagtggctcacgcctgtaattccagtactttgggaggctgaagcaggcagatcacaaggtcaggagatcgagaccatcctggccaacatggtgaaactctgtctcaactaaaaatacaaaaattagctgggcgtggtgatgcgtgcctgtaatcccagctactccggaggctgaggcaggagaatcatttgaaccagggagttggaggttgcagtgagccgagattgcaccactgcactccagcctggcgacagagtgagactctgtctcaaaaaaaaaaaaaaaaagataaaaatttgtaaagagcaaaaatatataacccccccaaaaattagatacacatatattatgttttggaaatatgtgtacagtatactggtttcttgggaaaagagcagattaaagcaactgatttggtgatgtatctacttatgtgtgtgttgctatgtctcaaacttcttcaccccaaataatcacacactcacacatgcagctttcccttcagctcaggctggaagtggatgtctagttttagggcttagagaccacagaaagtcctatattcagaggattgctgccagtgggtggtcattccagaaagatctggccggtgccaataagtccaagcctttccctcctttcctccttcccttgcaaagccctctgtcctgactttcataattgcaactctgattctaatcaccaggtggctccattctgtctctctttctccatcaaggttggctgatgtccacactgcagagcactctctggagagaggaggtggttcaagtcctcaaataccatacacctataatgacttcccgaatcaggccactttacatacagctgctcagaacggtttccctgaagttagctctaatattgtcacacaaacaccctcagaggcaatccactacccacccaagagaactatgcactctttcccagctggcatgcaaggctcctcatcccatggatccagactacatttccagcactctcttgcaagtgctcttggcaaactgtaccactgctcctctttcaagggactcttgtcttttttgtgtgcctctccattaggttaggggtcaatttgcatagactttggcccctgcccacacatgataacattaaatatttagatcaatcctttgaggagggattgttatcctcattttaaagaagtggaaactgaacctcagggaaagtgagaaccagtcttgtcttcgggaaagacactggggttatagaagtaagagacccagtggtagcttggtagtgataatgaacagtattattttgctctataacaaagaggaatggataaagtgcttgctacaattaagtgcctactatgtgtagtattaattttattatttatttatttatttattgagaggcggtctcactgtgtcacctaggctgaagtgcagagtggcgtgatcttgcttcactgcaacctccgtctcccaggctcaagtgatggatcctcccacctcagccacccaagtagctgggaacacaggtgtgcaccaccatgcccggctaattttttttggtatttttggtagagataaggtttcgccatgttgccccggctggtctccaactcctgagctcgagtgatccacctgcctcggccttccaaagtgctgggattataggcgtgagccaccgcgcccagcctattttttctaagatttaaataatatgtgttcaggctgggtgcggtggctcatgcctgtaatcccagcagtttgagaggcagaggcgggtggatcacctgaggtcaggagttcgagaccagctttgccaacatggtgaagccccgtctcgatgaaaaatacaaaaaaaattagccaggcgtggtggcgggtgcctgtaatcccagctacttgggagcctggggcaggagaatcacttgaacctgggaggtggaagttgcagtgagctgagatagcgccattgcattccagcttgggcaaaaagagtgaaactccgtctcaaataagtaaataaataaataaaatgtgttcattgtagaacatttagaaaatatattaaaacagagagagaatgggaatgaacacccacaataccacaactagaacagcccatccctttctaggatttgctaacatcaagtggtaggttcaagaatgtcaagttatacctataaaataagtgaagataggtcaagagagggtgaaaacgtttccaggttccatcttactctgactccaatatgcacaactccaattttactgcattgcttccccttttagatgatggatttctagatttctagagctcaggatatggctgtgttacatttgtttggaatggtgcacatatattatgaaatgatgcgtatatatgggtaccagtttatgtatctctcttgatggagataaaatccctttctttgtgctaaagggccaaggtgtatgaccaacatcacttggtctccaaggcagtaatatatatagaaaatctcacaggctttggaatcacagatggagtgcggaatgcaggcaagggatctaatacttatttaggagtgtgctatagtcagacaatgtaaaatttatactaggcttgagtaatgtctaggatgtattttttattctctaaggtaaccactacatgaatagtaatagaatctataattaacaagataatggggaaaatggaattataaaaaaccattatgcatttcaaaagagggcaagagaaaagagaaaaagcaatataaaacaggaagaacaaatacaaagcaaaaagtaagatggtagatttaagccccaaaataccaaatataccatctatataatatatattataggtaagcagcctaaacattccagttaaaacacaaaatcagaatgtattaaaaaataactacatgttgtctataagagatccacttttaatatgaagccacagaaggctaaaagtaaaaagatggaaaaagatatgccatgcaaatattaacaaaaaagctgatgtagttgtattaatatcagataaagtagactttaaagcaagaagtggtagtaaagacaaaaagggacatttcgtaatgataaaagagtcaattcagcaggaagatcaaataattctaaatttgcatgcatctaataatacagcttttaataatataacaacattatgtttgtgagattcatccatttggttacatgcggcagtagtttgttcattattattgccgcatggtgtttcattgtataaacttttctcagtattggtaaaataagacaaaaataagtaagactaacaaatatttgaattgcacaagtaatcttaacataactgacaaatgtagaaccctgcactctaaaactgcagaatacagtttatttttaggtacaaggagcatctacaaaatttcactacatgaaaggcataaatttagtctcaacaaacagcaaagggtgaaataacacagtgtatatcctttagctattgcaaaattaagctacaactttaaaattattaaaattataaaatgtctagaagaaaatataatagaaaatatttgtgatcttgtgtttggcaaactttttttggtaggacacaaataggacaaaccataaacggtgaataaataaactggatgtacccaaataaagactactgccctttctaagatgctgttaaggaaatgaaagctgaactatagacagggatgaaatatttgtaacttaacaaagctaataaaggactttatccagaatatataaagaactctcacaattcgatattaagaaaacaacaactgaattttaaaaatacaggtaaaagattagaatatctgcatctgttagagtggctttaaaaatgacaaaaccaagtgcatgtcagaattggagcaactggaactctcatatgattctagtgggaatgtaaaatggtacagccactttggaaaagagttttgtatagagttaaacatacacttcccatgtgactcaacaatcccactcctcagtatttacccaagagaaataaaaacataggtccacacaaagacttgcatgcaaatatttatagcagctttcttggtaattggcctaacctagaaacaacccaagtgtccatcatctggtgaataaataaattgtactatacaatggcatactacttagcaataagaaggaccaagcaattaatacaagcaacaacatgaatgaagctcaaaagcactatgttaaatgaatctcagacataaaaagtcttgtttcatttatatgacattccgagaaaagcaaaagttataggacagaaatcagatcagtggttttttgggggtgctgaggctgaagagagagggttgactatatggtacaagggcacttggtggggtgatgaaaatattctgtatcttgatcgtggtggtagttacatgactacatacacttgccagaactcatagaactttacaccctagaagaacaaactttactgtgtgtaaattatacaccaataaacctgattaaagtgatcccttttgctaatttgtaattaatctcttttgctaatttgcacaaagccatgtgccaactgggtggcatcttcctagaggaatctcttttgtctcatttatgcaaaggcaacaaatgagatagtagtggccttatcttattccatattgaatcctttttatttttgtatttttaaaaattttggtaaaattatatatagagaaatacacaaatattaagaacataattaaaaaatacacttgatttttaaaagcctatgatttttcttttgagacagggtctcgctctgttgtccaggctggagtgctatggtgtgatctgggctcactgcaaccttcacttctcaggttcacgtgattctcgtgcctcagccacctgagtagctgggattacaggcatgcgccaccatgcccggctaattttttgtattttaagtagagatggggtttcaccatgttggccaggatggtctcaaactcctggcttcaagtgatctgcctgccttggcctcccaaaatgctgggattacaggcatgatccaccacacctggccaaaacctatgaatttaaaaaaggctggaaagaaaccatcaaagcatctatctcaaggagctaggaaaaaaatcccaaccaaacagatcaaactgggttaagctggtgatgatgatataattcctcttttgtaaagttatgtttttccctcatggctatagcacctgatgatacaagcatccatccatgatccttttctgaatcaattatttcatggtgggggggggacggtgtcataaaataatctttgaattctatcatttttctatgtgtattagttaacattctcctaatctagaaggaagcactttccctcattaactgggctttttggttacccaaaacatggtttctgctggaaaggcaagtaactgcctaattcttctcctctaatgaaaccattgctccacttagtcattgttttgttgagtccaacagatttagaaaatataagaacttatgttccagttcaaactgttgctttgggtgttagttaagatgaattggtttgattggatagtgctaaatttataattaatttgaggaagaacataatatggaatagtatgtacaatatgatccttgtgtttaacctatatattctcatatagatacaggcatatatgggtaaagtatatggcatttagttaagtatatggtaaatgttgcatttcaagttctaataggggaaaggatctcttcaacagatgctcctgggaatctgggtatccatatgaaaaaaaaaaatcagagtcctatcttatgccacttattaagttccaaatagatttttagaacttagaatagtactatatcagtataggggagtatttttcttttcttttttttctttttttttgagacagggtctcattctgtcgcccaggctggagtgcagtggtgtgatcatggctcactgcagcctcggccttcctgggtccaggtgatcctcctgcctcagcctctcaagtagctgggactataggcacgcgccaccatgcctgactaatttttgtatttttttgtggagaggaggtttcaccatgttgcccaggctagtctctaactagtctcaaacgacccacccgccttggcctcccaaagtgctgggattacaggtgtgaggcaccacgcctgtccttaggagagtatttttcttttcttttcttttcttttttttttgagatggagtctcgctctgtcacctaggctggagtgcagtggcacgatctcggctcactgcaagctccacctccagggttcacgccattctcctgcctcagcctctcaagtagctgggactacaggtgtctgccaccatgcctggctaattttttgtatttttagtagagacggggtttcactgtgttagccaagatgttctccatctaggagagtatttttcataggcttcagttggggaagaaaaaagccataaataaaaagactgatgcatttaactacatcaaaatggaaaaacttcagtatatagaaagacaacacagacaagattaaaacaagctacagactaggagaaaatatttacaacatataaaacagagaaacaagtactatctatactaaatacagcccttctgcaaaatcagtaagataaaggtaatatcttttgtgccaggaaaacaggcaaagcatgtgaacaggcaatttacagagctacaagtaaccaataaacatgtgaacagaggcacaacctcactacttaacagagaaatgtaatctgcaacattgttataccacttatcagttatccaattgtcaaaatttgcaaagataatttttgcagcattgttttttattgcttaaaattaaagaaaacctaaatgtccatcagtagaggaatggctaaataaaccatactatagccacactatggaatacaatacaacagttaaaaggatcaacatttattgacaagaaaagagccccaagacatattgtagaatgaaaatatcaagttgtgaaacatatgtaccatttgataccctctaacaatatttctataggtacatatatatgcatgaaactcatagaaaaaggtctggcatgatacacaccaaactaataaagtggctttctctggagagggaattaaggtatattgaagtataatttatatacaatatatcacacacatcttaaatgttcaatttgaagagttctaacaatcatataatcccatgttaccaccacacaaaacaagatgtagaatgttttcatcatcccgaaaggtcctttgtgcctgtttctagtcaatttgaggtagaaggtgggactctactccaggggtggagctcagacaccagaccaaattgaggactagctaaaatagggactgggctgaagcaggtttccataagacatgcccacccaccagtgcaccatgtcaatttaccatggccatggcaacacctggaagttaccaccccttttctagaaatttctgaataacctgtcccttaatttgcgtataattaaaagtgggtataggtatggctgcagaactgccccagagctgctactctgggcacactgcctatgggttagccctgttccgcaagtgttctgctgctgctgtacactgccacatcaataaaagttgctgtctaatgtcacctgctggcccttgaattcttttctgggagaagccaagaactctcctgggctaagcctcaattttggggcttgcctgcccagtgtcagattcccctctattcccctgaacaccactttctgatttttatcaccacggattagtttcgtttgtttttacgtttcacgtaatggaatcctgcaatactcttttgtgtctggctctgttcactcagcatactggcttttttttttttaacttctcctttttgagacagagtctcaccctgtcatccaggctggagtgcagtggcacaatctgggctcactgcaaccttcaccccctgggttcaagtgattcttatgcctcagcctcccaattagctgggattacaggtgtgcgccaccacacccagctaatttttgtaattttattaatagtagagatggggtatcaccacattggccaggctggtctcaaactcctgagctcaagcaatctacctgcctcagcctcccaaagtgctgggattataggtgtgagctgccgtgctgggccagcgtactgtttttgagatttattcatgttgttgcatatatcagtactttaatactttttattgctgaatagtattctactgtatataggtacaacaatttatttatccattctcttattgtttctgagtttcagctattatgaataaagctgatataaacattcatgtacaagtctttgtgtgggcatgttttcatttttcttggttaaataatactcagaagtgaacttgttgggttgtatggtaagcgaatgttaaactttataagaacctgagaaagatttctccaaagtggctgtaccattttacacccctgatgataatatattagtattctggtttctccatgttctcaccaacatttggtgctgttagtcttttgatttcagccattctagtggaagtgtggtggaatgtcattgtgttttctatttgcatttctctgattactgaagatgttgaggactagatatctaccattgcaaagcatccattcaagtttgtgcccccttttacaatggatttttctttttattgttgatttgtaggagttctttatatattctggatgtaagtcctttgtcagctacatgtactatatgtatatttttccaagcctgtacattacctatccattttgttaataatgtctatggatgaacaaaacataaattttgataaagcccaactttctcttttattatttcaactttcaattttctcttttattattaatgctttttatgctctaaggcatctttgccttcctctaggacatgaagctattccccaattttttatgctagaaaccttatggctttggcttctacttctagtatgctaggaacacggaagaggtatttgtccctctgaaacaggttttatggaacaggctatcagatttagagagaatggataatagaaattaaatgtccatgtctgatagctttgaagagagcagtggttctcccagcacgcagctggagatttgagaacgggcagactgcctcttcaagtgggtccctgacccctgaccctggagcagcctaactaggaggcaccccccagcaggggcacactgacacctcacacagcagggtactccaacagacctgcagctgagggtcctgtctgttagaaggaaaactaacaaacagaaaggacatccacaccaaaaacccatctgtacatcaccatcatcaaagaccaaaagtagataaaaccacaaaggtggggaaaaaatagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcgctaaacatggaaaggaacagccggtaccagccgctgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagattcaagacccgtcagtgtgctgtattcaggaaacccatctcacgtgcagagacacacataggctcaaaataaagggatggaggaagatctaccaagcaaatggaaaacaaaaagaggcaggggttgcgatcctagtctctgataaaacagactttaaaccaacaaagatcaaaagagacaaagaaggccattacttaatggtaaagggatcaattcaacaagaagagctaactatcctaaatatatatgcacccaatacaggagcacccagatacataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatttttcagaccacagtgcaatcaaactagaactcaggattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggacgcattcaaagcagtgtgtaaagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctctcagaggtacaaggaggaactggtaccattccttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcattcctgggatgcaaggctggttcaatatacgcaaatcaataaatgtaatccagcatataaacagagccaaaaacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcagaagacagggatgccctctctcaccactcctattcaacatagtgttggaagttctggccagggcaattaggcaggagaaggaagaaaaaaaaaaaaaaaaagaaaaagaaattaggactgcttggtaggtccaggcacggtggctcatgcctttaatcccagaactttgggtggcccaggcaggaggatatcttgagctcaggagttcaagaccagcctgtgcagcatagtgaaacctcatctctatgaaaaataataataaaaaaataagctgcgtgtggtggtgcatgcctgtagtcccagctactcaggaggctgaggtgggaggatccttgagccctgggagatcaaggctgcagtgaactgtgattgcaccattgcactccagcctaggcaacaagcaagatcctttctaaataaataaataaaaggacttctttgtaggtatctgcaaaagaaaaaagctatgagggctgacaaaagttgggggggtgtaatacaaatagaatgcataacctccaaaccactataggtaaaataaattgatctaacacaaagctggcagtgggcggcggggaggggtgtgcggggaaggaacaaaaaagcatggtaagcagaaaatgcaaaaacaaatggcataaataaatccaaatatattgtaatgacaatgtgaattggttgtattcacttaaaaagagacagtgactctcagattgtgttaaaaataaaaatatacctctgtactgtattaaataagatggaaaaagataaaccaggcaaaaactaataaaaagaaagcagaagctgcattatcaatataagacagagtagaatttcagactgaaaggactaaaggacacagaaggacgcttattattaagtctggttatattacctagaaaatgtaacacaatcgtttatgtagttaactatagcttcaaaatatgcaatgcaaaatagtatatatatatatatggaaacattgttacatctacaatcatagttgggaggcttagcacacctttttcaataatccacagattagcaaaaagatagaggatttaaatttcacaattgatgtgctttaactaatctctctaatataaacaactttgtacacaacagaaaataacattcttttcaaatgcacttggttttaaaaagtgcccaggtattagaacatgcttattcaagagttaaatcccatcaatttcttttttaaaaaagtggaaagagtactcataggggtcatatttattattcataatttatttatttagcaaatatttattgagtgcttactatgttccaggccctgtttcaggtactggaaatgtagcaaataagaagcaatgtctcagttcccaaggagcttacatcctagatagaagaatcaaataatacataagtaaatgaataagtgataagtcctgtaatgatttcacattgcatacctgtatcaaaacatttcatgtaccccataaatatatacatttactatgtacccacaaaattaaaaataaaaaaatttaaaaaaggaaagaaagtcaaactcaatgatgccatagaagctgcagggatatttttaattgcacaattaagaaataccttgaagagaaggtgacacaatataatgaaataaaattagacattaatgcagtccccacaccgaatccaaaatttaagaaaaaaaagcatcttctaaatgactctgggttaaagaagaaataaaaatcatgacttcaaattatgtagatgagaatggaaataaacccaccagatgtaaaacctgggatgaggttagagttattaaagagggtcatttatacactcacttacatattcaaaaataaggaagacttaagataaatgaactagacatttaactcaagaatgtagaaaaagaacagtaaattgaatcttaaggaaatagaaggaaggaaaaataaagataagaaaaaaagaaagcaagaagaaaaaaatcacaatacaattgattgatacaagttatttgagaaaatttttttggcaattctgatcaaagaaaaaagaagagacaataaacaacattgggaattataattaaagatataaaaggcaataggaaaaatataagaaaatacaagtcagaattttataacactcaaattgaaatttcagacaaaatggatcatatattaataaaatacaactaatcaaaactggctcaagaagtagaaaacttgaatagaacaataaagagataaaaattttacttcaggccgggcatggtggctcacgcctgtaaccccagcactttgggaggccgaggtgggtggatcacttgaagtcaagagtttgaggccagcctggccaacatggtgaaacctcatctctactaaaaatacaaaaattagcccgacatggtggcacgcacctgtagtcccagctactcaggtagccgaggcatgaaaatcacgtgaacggaggttgcagtgagccaaaatcgtgccactgtactccagcctgggtgacagagcgagactctgtctcaaaaaaaaaaaaaaaaaaaaaaaaaaaaaaaaaaatcttactgcttaaaaacaaacaacaaaaggaaagaaagacaattactgtgctcagactattatttttagaaaagttcttccccaagcctttaaggaatggaaaaattctcttgttatataaactaattccagaacacagaaaacttcctaacgcatttcataaggctagtataattatattatgcatttcataaggctagtataattataataccaaaaactgaaaaaggatggtacacagaaaaagaaaactataaacggatctcatctacaaaaatgtaaaaccagatattagcaaattgaaatccagcagtttattaaaaaaaattgtcactaccgtgtgaggtttattgcaagaattcaaaggtggtccaatatttaaacatttttattgtaatctactatattaaaatcattaaaatatgataatctcaataggaaccataaaattttttgttcaaattaaacatccattcctgataacaactcctggcattctaggaatagaagtttccttaacttggcaaaggatttgtgtaggagatgcatagaaatattgtacttaatgatgaaacgtgaaaagcattcctgttatattcaggagctagactctgactataaggatgtctgttatcacctttactattcaacattactctggacttcttgttacatataataagatgaaaagataacatgaatagtataaagtatcagaaaggaaaaatattaaactgtcatttacagacaatataaatgtcttttgagaaaatcagagaaaatcaactgacaaacttttataactaataatacaaattcattagggtggcctgatacaaggtcaacattcagaaattgtagctttgctttgcaccagcaatacacaaatggaaaatggataagaagcttctatgttagaatagagggaagataccatttcaccagatctctcctaatattcaacaaaatgcagaaaaaacaaaacagcagaagaatggagatgatcatcagcaaccaaagaaaggggcacattccaatgacgtaaacttcaaaatatctcagccaagtaaagaaacaggagattccagaactgggcattgtggtgcagggtaaccaggctcttccattcctcagaagccatataagatacaggaagcacaagacaaagaatctaaacaagaaaaaagcgtaccacaaagaacagaaggaaatttccaagtactttaagctatagaacaacttaataagaatatgaacttaataaaacaagaatgcaaagatgagatgtgaaaacagcagaattaggtaaaaaggaagattgcaaactaaagaacccattaggacaaaacaacattatagaataaattataaatagagtgaaatagaaacatgtggctaaaaattgaattatggacagaggaagggcttcagataattacattgacgggaaatgaaaaagaagaaattaaatgaaataactatatgtacatatatatgtatatacatacacacacacatatatatattcttaagaaagaataaaatgtttagatctaaatagcataacatgtcctgggaagtttgattgtcatttgaaagttcgttatttcacagtgctagaatctgagatgatattttatcttattctgtgtactttattgcattgcattgcttctttataatgagcatgcatcatttttataaaaatagtgaaatcatttttctaaaaaatgtagagagaatataatgtacaaaaagccacattcacaatattaacaaaaactatgaaatattggggaatacagctaataagaaatgtataaaatctataaagaaaaccacacacacacacacacacacacacacacacacacacacacacacacacacgaaaaatgacaattttcctgaagagcacaaaagaggatgtgaataaattttaaaaatactacatgaccctgggtgaaaatactttattactaagattttaattattccttaagttgatctataaattccttttttttttttttgagacagagtcttactctgttgcccaggctggagtgcagtggcacagtctgggctcactgcaacttccacctccagggttcaagcgattttcatgcctcagcctcccgagtagcttggactacaggtgtgcgccaccacccctggctaatttttgtatttttagtaaagacgaggtttcacgatgttggtcaggctggtcttgaactcctgacctcaagtgatccacctgccgtgacctcctaaagtgctgggattacaggcatgacccaccacacccagcttaatctataaattggatgcaatcctaatgaaaagtccaacaagattttttaaaaatgaaacttggaacttcacttgaaatgcccaaggatatccaaaaatagttggaaaaagcagggcaatgaaggatttgtcttccccgacaccaaaacttgctacaaaacgacaccatgtaaaagtgtgatattgaggcagtttataactatatatattatcagtgaaacagaaaagtcaatcgatgaaacagatctgagtataaatgagaatttaacatatggttaagttagctctttaaatttattggggaataatggactattatatgaatggtgctaggatttggagacacacacacacacacacacacacacacacacacacacacacacacacacacatatatatgcaatgacccagaagccatacaagaaaaggttaatgttttgaccacatcataatgtaaaaattctggagttaggtgccatggctccagaatccaaagtgctgggattatagccctggctcatgcctgtaatcccagcactttgggaggtctgggtgggaggatcttttgagaccaggagtttgagaccagcctggggaatatagtgagaccctgtctctacaaaacataaaaattagctgggcgtggtgccatgcatttgtagtcctagctactcaggagactgaggcaggaagatcgcttaagcccaggggttcaaggcagcagtgagctatgatcacgccactgcagtccagcctgggcgacacagcgaaaccctgtctaaaaaagtaaaaattctgaatatcaaaaataccataaaattaagatgttagtgatagattgagaaaatatatgtacaacctatataacagaaaaataactaatatacagaaatgtgtaaagaactacaaaccatttaaaaaatacagctgaataggaaaatactcaaaggatattaactaatactcagagaagaaatgcaaatggatgttaagcatgtgaaattatgctcaagataatagatatttaggaaaatgtgaattaaaaggacaatcttgccaggtgcagtagctcacacctgtgtgatcccagcattttgggaggccgaggtgggtggattgcttgagctcaggagttcgaaaccaacctgggcaacatggcaaaaacccgtctataccaaaagtacaaaaattagctgggcgtggtggcatgcgcctgtagtcccagctactggggaagctgagatgggaggatcacctgagctcaggaaggtcgaggctgcagtgagctgtgattacatcactgcactccagcctgggcaacagagtgagaacctatctcaaaacaaaacaaaaaaaaggacaatcttttgttgactcttatattggcaataattactaatacagacggtccccaatttatgacaattcaacctatgatttttttactttaattggtggtgcaaaagcaatacacattcagtaaaatctgtacttcaagtactcatacaaccatcctgtttttctttcaatgtagtattcaataaattatgtgagatattcaacactttattataaaataggctttgcattagatgattttgccgaactgtcagctaatgtgagtgttccgagcatttttaaggtaggctaggctatgatgtttggtaggttggatgtattaaatgcattttagatttatggtattttcaacctataagtttatttgaacatgaccccattataagttgagaaacatttgtacacagtgtgcatgagagtgtggggaaatagatcctgtcttatgtttgatgggggtataaattgccaagcctttttggaggacagtttggtggtatatccattaactatataaaatctcacatccttcttttggcaatatcaaatgtataaaatctcatacatttaagcaaataattatatttatagtagaatatcctaaagaaattcttctacctgttggcaaagctttatgtgccagactgttcattgtaaccttgctttattagctccggatccagaactcataatatgcagcagttaaaaagaatgaagcagctttaaatgtactggtatgtagagctctttgagacataattttaaatgaaaaaaaagcaagttgcaaaacagtatgttaattatgatcctggccaggcgtggtggctcacacctgtaatcccagcactttgagaggcccaggtggttggatcacttgaggccaggagtttgagaccagcctagccaacatggtgaaacccagtctctactaaaaatacaaacattagctgggcatggtggtgcgcacctgtaatcccagctactagggaggctgaggcatgagaatcgcttgaacccgagaggtggaggttgcggtgagccaagatcgcaccactgcactccagcctgagtgaaagagcaagactccatataaaaaaaaatctcatttatatattttaataagacatgtatgtgtatatcatgtatacaaaaggttaatacaccaaacttaaaatggagaggtaactgtgatttgggtgaggataggggagtgaaagtggtactagtgctttttctgggtttgactattcttttcttttcttttcttttcagagacagggtttcacgccattgccggtctggagagcagtggtgcaatcatagttcactgtaaccttgaattcctaagctcaaacaatcttcttgccaagtagcctcccaagtagctaggaccacaggcatgcaccactaagcccagctattttttttttttaatagacaggtttccctatgtcgggaaacctatgtagggtggtctcaaactcttggcctcaagtaatgctcttgcctcagactcccaaagtattgggattataggcgtgagccatcacacttggccttgggtttgaattttatactagaattgtactcttgtgggatttgtatgtaaagtaaacagcaaatattaaaacaccccaattatctttccactgggatacacagagctaactccatcagccacattgtataaatataacatgagttatttaatctctcccctatcaatagccattttatgttgcgtcaggctttttttttttttttttttttttttgacagagtctcactctgtcagccagactggagtgcagtggcgtgatctaggctcactgcaacctccatcccttgggttcaagccattctcctgactcagccttgcaagtagctggggttataagcgcctgccactgcgcccggctaatttttgtatttttaatagaaacggggtttcaccacgttggccaggctggtcttgaactcctgacctcgtgatccacctgcttcggcctcccaaagtgctgggattacaggtgtgagccaccgtgcccggctgcgtcagttttttcaaaccttacaagcattgcgaaaaaaaaaaattctagtaaatatatctttgtgaaactgtgtaggcatataggttggctaaattccaaggaatagaattattgggtcaaagaatttgtgaaatattatagttatcatttaatagagtttgccaaattgccctatataaaaagcttgcatcaatatctgcctccaacagagtagaggagtgcccatttcttgacaaaccagtcaacaatattatcaagtttctaaactttgagaaaatcatacttgaaacatggtaaggcatagttgctttgatttgcatttctttgtttgagcatcttttcatatgtttattagtaatctatttcttttctgtgaacaaatctgttcatgtcttttggcacatttttctattgggttgtttatcattttactaatgatctgtaagagcttttagattattacaagttagccttttgacagtcaatgtttatggttttttttttttactttaccaaagtttaaaatttgtatgcaattaatttatcaatattttcctttggtggagaaagtaagttcgtcactttcaattgagttctgaaaagccattagtaagattgtaaggcactaggacttcctttcttggctcctgaaagggcctcctccacacaggggcccctcacagtggagcccctccctctggggtgtcctatttcaatgttctaagaaagaggctgcctggagggtctatatttggagtatgactcctcagcggggacaggtggatgcgtggggactaacttctgcatatttggtccctgagttttgggattattctgaggggcttgtatgggaggtgcagtgaagttgtaacacaaggcaggacatgaaaaaacttctttttcttggcaattgcttgggatcctgtacattgcccttccacttgtgagggaaaaaaataatgacacggacatcaggtgtgttgcagtgattcacagtcatccacagaccctcaccaccatctccactggaaaatattgaacactcgccactgctagggtagtatgtagtacatgaatggcagacaccggcgagatctcaagtgttacgacggatgaaaattccacctgttaagtctcctttccatccaagctctagcagttggttgttccatgggtgtggtgaggctgatctgattacatgcttatgtaaaatccaaataaagccccttgaatggaaaacaggttaatttgggaagtcactagtaaagcaggttaatttggtaagtcactagtaaagcactaggctcatcaggagttgggtcttaaatatatcctctagaagtcttctctgaagaaggtcttagacacctgaaaaaagatgctgagttcagccagaacttcaaaagttacaaatcacctgtgtaaaattgtcaatattagaaaacgaaatgtctttccaaagattaacttatagatcatattgaatacgtgctggttttgtttaggacaattttgtatttaaaatgtcaagaattactagtcaattttgaaagctgtaaaatagtttgcagtaacagaagacattttaaaatgtggcacaaaataatgtaaacaaaagaatgagtcttttgttatttttacaccctgaatattttttgtgtcaaatgaaaatggctatactgtattttctgattacaatattagaaaagaatgtcatattaaaagaaaaaaaaggaacacgaaaaagaaaattaaagctctacttgcaccttctgctttccttcctgatacccccttccacagcccatttggtgcaggcattgtacttagagagggcaggtcgtgtagggggcgggtggggagtgctggtcttatagtctaagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcagattggagaggacggagatgagtgacaacgcgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 4792 - DNA, 48026 bp, human
cgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 4793 - DNA, 13591 bp, human
tcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagaga

SEQ ID NO: 4794 - DNA, 48003 bp, human
ctcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 4795 - DNA, 47984 bp, human
tccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 4796 - DNA, 115171 bp, human; identical to SEQ ID NO: 4791

SEQ ID NO: 4797 - DNA, 10354 bp, human
tcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaa

SEQ ID NO: 4798 - DNA, 31700 bp, human
tgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaa

SEQ ID NO: 4799 - DNA, 1765 bp, human
atgtcccacagggttgcaggcggctgcagtggggaccattcccaccaggtctgggtgaaagcctactaccgcggggatatcatgataacacattttgaaccttctgtctcctttgagggcctttacaatgtggttcgagacatgttcttttgacaacgaacagctcttcaccatgaaatggatagacgaggaaggagacccgtgtacagtatcatctcagttggagttagaagaagcctttacactttatgagctaaacaaggactctgaactcttgattcatgtgttcccttgtgtaccagaacgtcccgggatgccttgtccaagagaagataaatccatctaccgtagaggtgcacgccactggagaaagctttattgtgccaatggacacacttttcaagccaagtgcttcaacaggcgtgctgactgtgccatctgcacagactgaatatggggacttggatgccaaggatataagtgtatcaactgcaaactcttggttcataagaagtgccataaactcctcacaattgaatgtgggcggcattctttgccactggaaccaatgatgcccatggatcagtcatccatgcattctgaccatgcacagacagtaattccatataatccttcaagtcatgagagtttggatcaagttggtgaagaaaaagaggcaatgaacaccagagaaagtggcaaagcttcatccagtctaggtcttcaggattttgatttgctccaggtaataggaagaggaagttaagccaaagtactgttggttccattaaaaaaaaaaaaaaaacagatcgtatttatgcaatgaaagttgtgaaaaaagagcttgttaatgatgatgaggatattgattgggtgcagacagagaaacatgtgtttgagcaggcatccaatcatcctttccttgttgggctgcagtcttgctttcagacagaaagcagattgttctttgttatagagtatgtaaatggaggagacctaatgtttcatatgcagcgacaaagaaaacttcctgaagaacatgccagattttactctgcagaaatcagtctagcattcaattatcttcatgagtgagggataatttatagagatttgaaactggacaatgtattactggactctgaaggccacattaaactcactgactacggcatgtgttaaggaaggattacggccaggagatacaaccagcactttctgtggtactcctaattacattgctcctgaaattttaagaggaggagattatggtttcagtgttgactggtgggctcttggagtgctaatgtttgagacgatggcaggaaggactccatttgatactgttgggagctccgataaccctgaccagaacacagaggattctctcttccaagttattgtggaaaaacaaattcacataccacgttctctgtctggaaaagctgcaagtgttctgaagagttttcttaacaaggaccctaagaaacgactgggttgtcatcctcaaacaggatttgctgatattcagggacacccgttcttccaaaatgttgattgggatatgatggagcaaaaacaggtggtatctccctttaaaccaagtatttctggggaatttggtttggacaactttgattctcagtttactaatgaacctgtctagctcactccagatgtcgatgacattgtgagaaagattgatcagtctgaatttgaaggttttgagtatatcaatcctcttttgatgtctgcagaagaatgt

SEQ ID NO: 4800 - DNA, 561 bp, human
gctcaaaactttaaaaatggcagttgtgttctagacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataa

SEQ ID NO: 4801 - DNA, 97165 bp, human
gacgcagaggcgaggccgccagtcgaggacgaggaggaggtgagggaccagggtcgcgagggctgtgggggataccctgctgcctgagtccaggccggcagagccccttcaggaaggtctggagcagtagctaaggagttagaaggtattccaggaccaatgaaaggtagccagagccgaggaagattcctttcctagcttggtcagtaatgtgcagtgtgccccgcttctggcgagttaattgtccatctctgggccttgttttcctcttctgcttgcccaagaccagacttctttgatttcagtaaaggaagtgccactaattccccttcccctcgaggcctgtttgaagaccctagttgttcctttgagaacctttgagccctggtacttaatcctttcaactgacggcagcgggttcagtcaccaggacacacaattgtagttgaagagcgctctttctttttgtccctgggcgagagtcaggtcttacacagcttgcctcttcttttctctccaattccagataacatcaagatgccgaagactgaggaaactgtgctccagaatgatcccagtgtagcagagaatggggcccctgagcctaaaacaccagggcagagccagaaaagcaagagtttctgtttagatgaccagtctcctggtaggtctagaatcatgtcatcacttctatggacagcaattaggctaaaggaatagacagcctgtgatttaagggcctttaagggatatagaaggctcttgcaaccttgcatttttccttactaatccttctgttagtcctcttttggattattctttctcttgtctttctgccccctctaatttttacatgcaggacttaggcccctaattggtaagtaaaattaaaagattttggttttagagaaagagaccgacaaagcaagttacttgtgtttgacaacagtcgagagtgatttagtcagttcaaagcctgggaaataaatagcattcttgtattttgattttgtaaagtgcaaatggtagatctaggacagatcgaagtgatccaaattatctgttgcttcagttgtgttctgtccttttccaggggtgctttgttgacataaaaattaccactgctctggggtaaaattatttaggtctttaataatagcatttttatgtgaacattgggactttaagtctttttcacaccttatgttaggcatttgaagctttggcttgactagtccaacctcacaggaactcaaattgcagttcttttacaataatctccagtgaatttaaccaaaggttaatctgcagacctctccagatgtagcaatttgatccaacctcttgaacactgaaacggggaaaaaatatgaagttgaattacgtgtgtttctctggtggccacttggggtcactgctagtaagcagaatggcacaattcatacttcataatatctctcaaagaaatgatgtcttaatgaattaattagatggtatattttaacatatgtagctttttagttagtatagaagggaaataccagttgatggaccaacttttcaacagaagtcttatcaacggttttttaaatgaaaaataaatgggcataaatggaccatcttcttggagtgagctttaggattcttatatgtgagttttattatatcttaaggataaatcgttctctctgaccaagttatgaaactacattaaaattgagttacaaaatagttttattgcatattttattttacatatcaagtaataattgtgactactatatatactttgttttactactgaaagtactctgtatgatgaatttagaacactggttcccaaattcgaatgctgggctaggacatagttcttaccaatattgaatgaaataaaacaataaagaggttgtaatgagtttttaaaataatattaaattgattcaatttaaaagagtactcttaatgctgactgtgttttctttatactttctgaggtgttaaaatatgttttctttttatgaagtgattattttgatgatggtagggtagtttcattgtttgcttgtttgctttcatgtccatatgtggaaaaataaaaattgtcaaatcattatctgtcactcatgttgttttgaagtgttgtctgttgaatacccagatttggaaactactgttttaggagcaggtttcagctttagagccatctagtaagattcgtgtggtatctataaggagattttagccttcatcttgtgtgtagcccctgaggtaggaagagaacagtgggaacacaataacttttagatacacattaattttacaaatcacaacttattcattgtttgctgtgttttgcttatggttttacatttcaagtggaaggttttcaaaactgttttatgtttttcaaaaactaatttcttcctcccatgcctgacttctctgagatgttcagtgttactgaagagcaaagagttcagaaaacttctggtggtaaaatgattgaataagtctgtgtaagatccgtttgatgaatctaaacttgggagccttacttggcagagtgaatctctaaataaaataaaaattctctttgtgtgggttccctgttgatgatggctatgctttttttctttctttttccggaaagcagacctgatgtcttttctgtcacagatctgatagagacagttaatgaagtttccaagctgagcatttcacatgaaattgtagtaaaccaagatttctatgtggaagagaccattttgcctccaaacaggtacagattattcagtttttttccattttactcttcggggcataggtacatagcacagatgacttttggtcagacttgaagcatcttattaataaatttaatggttgagtgtgtcttatatagtaccgacaaattagtgtaagtattactttaaaagtgtcaaagcagcaaattatatttaaacaggtaataaaccaatgcagttacaggttgaacatcccaaatcggaaatccacgatgctccaaaatccaaaacattttgagcgccaacatgatgctcaaaggaaatgctcattgcggtatacaagtatgctgcaaatattccaaaatccaagaaatccgtaatctggctaggcgcagtgtctcacgactgttaagttccaacactttgggaggccgaggcaggtggattgcttgagtccaggaagtcaaggccagcctgggcaacatggcgaaaccttgtctatgcaaaaaatacaaaaattagccgggcatggtggtgcatgcctgtagtcccagctactcaggaggctgaggtgggaggatcccttgagcctgggaagcagaggttgcagtgaactgagatcgcgaacacgccactgcactccagtctgggcgacagagtgagaccctgtctcaaataataataataacaataataatccgtaatccaaaatactcccgtcccaaacatcttggaaaaggggtattcattctgtattgtcaaaatgttcatttcaggatcttagttaataatgaaacgtagagtgattttcagatcttttcagacagacttggaagaggtaactcctagccgttcaacttttaattatctgcagattaaacaggcagagatgagcagattttctaatagtggttttgttcactcttcaggagtaggaaatttcaggggacacttctgcttcataatcagtgtaataaagattctgtgaatcaagattagaaccccatcgataaatagtgtgcttctacaattaggctttatattggtttctcttaattatattgatataacaatatatgattaagaatcatccagcatttatggattgaatgcttctagtgtttattaagagttaaatgggttgatttctttgtcagaatctatattttacggtatttctaatttcccaccttaaatgcttctgttattttgccacttttgggattctgttacgtaaagccccttgctttgtcagtggttctcttgatcttcatacttcttagattttcctttgtctgttgccaaggatgggttacctgaaggaagtttttaccaaaacacaggtctcgtagcatctccctcattgcctttatagtccctgcggcccgagttagatttgtttttctcctggtaggggtgcagaaaaaagtgaagctaagagaatgaaggtctgttaaagtggctagggatctcagggggtggatagatgaagcaggaggaataatattatttagggcttggatttcactgtgttttttaaattaacaggctttttcaaatgtagtaatacaaaatgtatactggataagaggttgaaatagagtttggggttatccattatctacagataattgacagttttccctttggacttataaaattatactaagcacagttatcggtttttaggggaaatctcataataagacatttattcaacaaacatttattgagtacttattaggtggaaggcagaatgttgaaagctgaagacatatagttgagtgagtcactgtctttgccatcaaaaagcttctgtagggaagatagtcaaatagctactgtgcagagtgataagttatctcatatctagtgtgtggagttctatgcagtgctcagctacctggggaaggtcagcgaagactttcctaataaggtaacacttgaattgagtcttttcaggtggtttaggggagaagggactctcctggaagaggaaatgtcatttcagagccatagagggatggaagacaattatatattaattataagtggactgtgattgttagagcacaggatgtaggaggagaaagaaggttaaggtaggagaagtggcagaataggatcgtgaagggacttaaaggccacgtacactgctagagataggtagcgtctgaagaactttaaatgagtatactattatgatcagatttgtatcttagaaaactcattgatttttatcaaaaatatgtaccattgttggggtaaggttttgtgggtgtaaggtggccatttaatagactatagcaatagttcaggaaagagatgacagtgggtgggggccgattccagagatatttaggaagcaaaatctctggaattgggtgactgagtggataaaggacatgaggggaaaggaattaagaaggactacagtacacaccagatagataatagttgaactttcacaggttagattgttgtgttggaggagaaactttgaatttttgtttcatatattttttaatcacttgtatttttgtaaacagaaaacatacattactattatatacatacacgtatatatacacacgtgtgtgtatatatgtgtgtgtgtgtatatacatatatatatatatatatatatattttttttttttttttttttttttttttttttttttgagaccgagtctcgctctgtcaccaggctggagtgcagtggcactatttcggctcactgcaaactctgcttcccgggtttaagcaattctcctgcctcaacctccggagtagctgggactataggcacccgccaccacgcccagctaattgttgtgtttttagtagagacggggtttcaccatgttggccaggatggtctcaaactcctgacctcgtgatccgcccgcatcgacctcccaaaatgctgggattacaggcgtgagccaccgcgcccggcctactattatatttttttaaagagaaaaagtctcagatttctggttacagaactaagtatacatgaggaacaaatttaaagaaggaagataaggagttcagttttgggcttgctgaatttaaagtgtctcagaagaccttcaggtattatcaagaggtaaaatcctttcctagatttcaggcctgaaggaaaaatagcatctggttcaaagttttaagtctatggcagtggaaactaagtcacacatccaggctaggtgcagaactagggttagaagtcagagtctcaactcctagtttatggttcttcctgctgcaggaagagagtgtctctggaaccttgaggtacccttctgagagaatttagccaatgcttttccatctgagactaccttcagtttattcagcccttctcaagtctaaacataggtcctcctagcctgtcaagttaatggtctttcataattttaaatgctgtttgggaaattatgatcctgtatcaattttctaggtaaaagagcaatctgctcatttaacccttcttatagtgtagaaggcaggtttgcggaggcaatgtacaatgctttttggaaccatctgaaagaacagctattgagtactcctcctgacttcacttgtgcccttgaacttctaaaagatgttaaggaggtgagtaaccaactcccattcgtggatgggaagttcctgggcatctcagaaccttggatcgtcaatggctgttaatatatcaagtagcatactttttttaacgtgacctactacttaaatagataggatggggcagcttccattttatttgtataagatgaaacttgaccattgggcgatgactataacaatatataactcaattaaacaaattcttactgaaaccccactatggtctatgtgtttcagaatcccggagatgaataggcgagcccttgcccacaaggaacttgcatgcttgagtcaaaaggctatttcaagggaaccttaaagattccagatttgctattttatcctcacactttggagtaaaacaatctaaaaatatccttatcctttattaagaatgcctcatctccttgtggtggtgtgtatttcatatttcttatatcccacacatttaaaaccacattcttatttttattcatatttttacctcattctacctaaaaaatagtaatgactactactataactgatcccagtgaagccttgaatggtaattgtcctctagacagaaagaaataatactctctaagaaatgtagagactcagttctctgcccccccagaagacataatctgggatgcctttggcctaagagcatagttcattggagaaagtttgaggttctgaacagaacttggctcctttgatttcctttgttgggcagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggtgagagtctagatgtgctgtcccccaaatctgccttagacactgtgccggagaactctgagccagccactgtggatatagcccctgtcttatctaactcttgtgtactgatgacctgactaacacaccttttctcctttctggattattggcttttattttccaaggacagtctctcggggttccttttgatgatctttagatcagttgggtctcctttatgtcatgatactgttaagacattaagttacagtaattctttctcctatagattgcaaattgccttttcccagatgttgtcctgtttgtcccaactcagaccttgtgaggggacaggaaagaggattatccgtgtttcacagctagaagaaccaggacccggaaaagtaaaatgatctgctcaatgagttagaaattcagtcacccacatcccagctacccacatataattgttaacaccttggtgattttcctttcactgactacccttttttcaaggtgacagactgactacaggcaaaagagctctcatctggttgttaaagtgtcaggaggtataactgtccttagttttgccatcaactcactctatggccttgggtcactggccacagtaccattattcataagttgaaataggactgtttgtttttaaggcttcttctgactctcaaatactctgcttttatggctccttgcttggattccacccttccagactagatttcctttaatagtgtaaatgttctgtttctccctacggcaggggcatcctccgtgttctgggcctaatgaaaatggacatggtgaactataccatccagagctttcgaccctacctgcaggaacattccatccagtatgaacaagctaaattccaggaactccttgataaacagcccagtatgtttaaaattcaagggcaggagaggggagatttgacctcaggtctgccttcttatagcaatagaggctattttctattttttgaatagaaagtttcttccttgggcaaggggtagggagaaggaatgtttctctaagatagaaagatctacaaaatcacttctttatagaccaagagtatgtctcagagccatcatctttaagccttggaattttaagatgcatattcccttctcgtcgtaggtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagaggtagggatgtgtgtttgggcattgccttgttctatggtattcagtgcctccattcaaaccctcctcttctgatgggctgtccttcgctccctcaccagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggtaagattcatagatctctgttagagagggaaatgtgtggtatttgggacataggtaatatcaatactattattgcttattcttcatcacaaaccacacaaaggcccttggaaatgatcttcaaagattttggtatctttgataatttgtattgaggtttgggatacagaaaataaaacttattttccaaagaggagagtgtggaagccagtttgctacaaatattccttatgtgtttgctaaaaatcagtcattatatacgtgattgaatgacagtggatttgtgctatgtatatctagaagttgatcggttggtcagtgatattgaccattcactgcatgtgggggcagggatattataccaaagtacaaggaggagtaggaagtccaagcctcttaatatattagcaatttaattggtggggtaggagaaaaaccatgaaaaatatccaatagagtcttaaaacaacatttaaatacagttgatgggactggagaatgccgagtagatccaaggatggaactgaacccttgcccaatttactttgttttcatcgaagtggcatatggtgctgtgtgtttggatcaggtggtaccttgcgggtaacaatgagtgtatttcatctgcccagtggctaatgctgtcttctggtggcagagagccagaattcttcctggaataggcctggcttgtggtatgaggctctctgggctttgcccctctgccaggcccactctgcattctatcccttattatctaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggtaagaatctccatggtcgtcgtgcagaaaagtggcaagaatgtggggcatgggtgggtagaccttaccctgaatgtgagttacctaagcatttaaaaatgaaaaggcatgatcatttgggaagttttttagctttagtttcctcgtctataatgtgcactgttcaaatagatctttctcaatttggagaatgcatgtatggtttgaagacagctctgtacccaagatatgtcattcacaggtgttggatattatcacgctaaccctatgaagtcattcctggtattttctcttttcttttcttttcttttttttgagacaaagtctcactctgttgcccaagttggagtgcagtgacacgatctaggctcactgcaacctccaccttctgagttcaagcgattctactgcctcagcctcccgagtagctgggactacaggcacgcgccaccatgcctggctatttttttttgtatttttagtagagatggggtttcaccatgttggccaggctggtctcgaactcctgacctcgtgatccgcctgcctcggactcccaaagtgctgggattacatacgtgagccaccacgcccagcccattcctgggtcatattctaaatgtcggccaagatatatggaggaaccctttctctatcctatgctttaagctaccatttgggcccctacgcctctccatggaagtgatgctgagttgggctgtaggacatgttccatgctggaatggaagcagtgaacttggccagcttgctttgaactttaccatctgatcatagcctggattgggtgtatgggcctgaacttggtgcactggctgcaacatgtgttgttactttcaggtaccgggtctacggtcctcttgttaagttaaacgtgccctaggatctcacatacagctacataaagtaatcttatgaacccccagaaatttactacctcagcatcttttgatcatgcattgtcctttgggagattgatggcattccattcccccaaacaaacaaaaatctcatgtatacggtttacccaaatgagcagagaggtcagtgaataactcggttaatgcaaaactttggtgagcagatagagcaaaggcattgtgaatttcttctgtaccgtcttcgttcctcttgtcattgtttttccctgctcacagatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaagaaaatttcagttcctcctgtgttctagctgaagtcaggttctgcagcctcatcccctaactagctgagtgagaatccagtgggccctctgttttcccttcattggctgatcattcttcagtatgcttgcctgagccgaatctgggcatcaggtactgataagggaaaatcctgggactgtatagaataatgccccctgaaaactgggaaggagctaagagaccaaagaatgacccggacaagtccggcttgataagcagatgaatttcttgggacttacgtatagggcattcctgggtggcagcaggacagctctggggatctgccctgacactcctctgcaagctgcttttaagctaattttctggctctttgccttctgtatgcaatgagactctttctcttggtatgtttcccagtacactctgggatgttttggttctcacagacacctcggctcctaagctgggcaccatgcatggccttagaccaccacctggccttcagggttcaggcagcagacatacagccttaagtaatctggtgggggaggggggaactcattaacctacagtcactagcattattttctccattgaaaaatcatttccttgagggctttgaaaactctttgtgagattatccagagaatgactataagggcttctggaagtcagaaattcactgaattgcagatgaagagaagacatagaactccatttctagcaccacatttccctgtagttttcaaggatacagcaatagcaagagttgcgaactcccgttctagtgtctggtttgaagcagtatgaaaactggggattggttgaaagttgatatggtgaatatcaactttgtgccaacaggcattcagctaaggacaggtctcagcttccaagggatttctttcttttaagtgattctaggggtcaggcttggaatctctgataatgacagtaaaccgaagcaattaggtcagtgagtatcatatcaagttcaccccgatcctatttctacagctgaattaatcttatctggccacatctctaggcttagaacatctccttcttcttgacagaatcgatgtgcgtattcaagcgtggggcagctgccatgctttttcccactcctagtctgggactccaactgccaagttatgaatatcagctgacttggcaacacaaatgatagatgttcttggtccacaaggacttgggcttgttgttagagactgcagaggttcgtcccatcgttcccaggccaactgcagcagacaagcagcaatctagaaaattaggaacaaatttaggtttggatttggactaggtttggattcagaatggacaggggacaatagaaacttacttatgggatagacccaaactggttgaaaaaaatcatgtcctcattatttcggcggatggaaggagctgagtacaatttactcagcccaagaaaaacaacagatgagattggagttccattactccccagggaaccacgtgattgatttccctagagggtggataccagatgggtgacatagctgggtaaacagagtgctacttttactttggctggagatgaggcacacagaaaagctgtggaatggatcattcacgtgttctaatcttgtgactagatagtctcaggacagagaccatggcagatgaatgttttataattaataaataggcagtgagcctggcctagttaaattttctaatgtgattagacaatacgaatacaattttttaaaaaagtattaattttgggagccagattatcttacagacaagtgtgttctgaagtgatccctgtgaagatgacggagtagttgacggatactgactttgggctgcaatgaaactttgctttatactttataattaaaatctgacttgtgttgatttcttggagattttgagtttattgattctcttgtgcttctacgtggaggaaatgggaatcctgatcctaaacaaggaaagatagctcactcaattctgttcaccatttagggatggatggatgcacagttagatagataggtggaacatgcacatggttaaaaatgacatgcagtacagagaaaattcggttttttcgccacccctgtatctcatttatcctacttagaggaaactatatccaggtttttgtgcatacttctaaagatattctgtgcatatgcaagtacatattataattataacaaatatttgtgagtgtgtatgcaccaggcactcttttaagcactctacatatattatttcaattattccttaacaatttatctccagtctacttttccaattctagaacaatgttgtacagaaagctctaactgagggtaagaaccggtgtttgtttgtttgtttatatatttatttatctggtcttctttgagtgagtaagggaaaatcatttcactttcttgggctttgtcttcatctataaaattctatacttgactaaattactgattttcttgttcaattttatagagtcatttttcacaaaacgaaatctttccagaagatcacgaataagagagatcaaagctaggcagcttgagttgaagtagagctggaagaaggagttttgaggactgtttcaaaaccactggactagatgatctctaaaggttcctgtattattttcttcttttcttatggctgttgtaacaaattaccccctgaactttgtggcttaaaataacatgcatgtattctcttatcatcctgattgtcagaagaccaaaatcagtttcagtgggtgaaaatcagggagtcagtagggccaggctccctctggaagctctaagggagaatccattgccttgccatttttagcttctgaagctgtattctttattccttggcaaggcaatggattcttccctggagcttccagagctcccattcctttatcatcgaagccagcatcatagcttcttgtgtcagtcatcacattgcctccttctatgtgaaatgtccctctccttccctcttaataaggaaacgctcttacatttagggccaggcaggataatctccccacctcaagatccttagtcacatttgtaaagtcccttttgccatataaggtggcagtcaggggttccagagactacaacatggatatctttggaggccattatttagcttaccacagcctaccctctaactccccaaaattcatgttcattctacatgcaaaatatatttgcctcacctcaatatccccaaaagtcttaacaccaacgcgagttgaaaatctcatctgtaaatcatctaaaccaggtatgagacagactctgggtatgatccttcttgaggctaaatttcttttcatcagtggccctgcgaactagaaaataaagttacctcttttttattacagtggtgacatggacataggataatggttatagacagtccccctcccaacgggaaaaaatgaaagcaagcaaaaagttaccagctccaagccaacttgaaatccaatcaggtaaactcatttaggtttcaaggcctgggaatattcctccgtggctagaggctctgccctctatgcccgaggctccaccctttaagtgaacagagccaggctctgtcctcagagttatcttgtttttgtttttgttttgaagagtaatacatgtttgcagcagaatactttattattattactattattatactttaagttttagggtacatgtggacaatgtgcaggttagttacacatgcatacatgtgccatgctggtgtgctgcacccattaactcgtcacttagcattaggtatatctcctacagctacccctcccccctttccccaccccacaacagtccccagagtgtgatgttccccttcctgtgtccatgtgttctcattgttcaattcccacctatgagcgagaatatgcggtgtttggttttttgttcttgcgatagtttactgagaatgatgatttccgatttcatccatgtccctacaaaggacatgaactcatccttttttatgactgcatagtattctatggtgtatatgtgccacattttcttaatccagtctatcattgttggacgtttgggttggttccaagtctttgctattgtgaatagtgccgcaataaacatacgtgtgcatgtgtctttatagcagcatgatttataatcttttgggtatatacccagtaatgggatggctgagtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgttttttggctgcataaatgtcttcctttgagaagtgcctgttcatgtccttcgcccactttttgatgggatcgtttgtttttttcttgtaaatttgtttgagttcattgtagattctggatattagccctttgtcagatgagtaggttgcgaaaattttctcccattttgtaggttgcctgttcactctgatggtggtttcttttgctgtgcagaagctctttagtttgattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctgcatagggctagccagttttcccagcaccatttattaaatagggaatcctttccccatttcttgtttttgtcaggtttgtcaaacatcagatggttgtagatatgtggcattatttctgagggctctgtttggttccattcgtctatatcccttttttggtaccggtaccatgctgttttggttactgtagccttgtagtatagtttgaagtcaggtagagtgatgcctccagctttgttcttttggcttaggactgacgtggcaatgcgggctcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagcagtttgtagttctccttgaagaggtccttcacgtcccttgtaagttggattcccaggtattttattctctttgaagcaattgtgaatgggagttcactcatgatttggctctctgtttgtctgttattggtgtataagaatgcttgtgatatttgcacattgattttgtatcctgagactttgctgaagttgcttctcagtttaaggagattttgggctgagacgatggggttttctagatatacaatcatgtcatctgcaaacagggacaatttgacttcctcttttcctaattgaataccctttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcttgaagggttgttgaattttgtcaaaggccttttctgcatctattgagataatcatggggtttttgtctttggctctgtttatatgctggattacgtttattgatttgtgtatgttgaaccagccttgcatcccagggatgaagcccacttgatcatggtggataagctttttgatgtgttgctggattcggtttgccagtattttattgaggatttttgcatcaatgttcatcaaggatattggtctaaaactctcttttttggctgtgtctctgcccggctttggtatcaggatgatgctgtcctcataaaatgaactagggaggattccctctttttctattgattgggatagtttcagaaggaatggtaccagctcctccttctacctctggtagaattcggctgtgaatccatctggtcctggactttttttggttggtaagctattgattactgcctcaatttcagagcctgttattggtctattcagagattcaacttcttcccggtttagtcttgggagggtgtatgtgtcgaggaatttatccatttcttctagatttactagtttatttgtgtagaggtgtttatagtattctctgatggtagtttgtatttctgtgggatcggtggtgatatcccctttgtcattttttattgcttctatttgattcttctctcttttcttctttattagtcttgctagcggtctatcaattttgttgatcctttcaaaaaaacagctcctggattcattgattttttgaagggtttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaattcgcctctacacactgctttgaatgtgtcccagagattctggtatgttgtgtctttgttctcattggtttcaaagaacatctctatttctgccttcatttcgttatgtacccagtagtcattcaggagcaggttgttcagtttccacgtagttgaacggttttgagtgagtttcttaatcctgagttctagtttgattgcactgtggtctgagagacagtttgttagaatttccgttcctttgcgtttgctgaggagtgctttacttccaactgtgtggtcaattttggaataggtgtggtgtggtgctgagaagaatgtatattctgttgatttggggtggagagttctgtagatgtctgttaggtccacttggtgcagagctgaattcagttcctggatatccttgtgaactttctgtcttgttgatctgtctaatgttgacagtggggtgttaaagtctcccattattattgtgtgggagtctaattctctttgtaggtcactcaggacttgctttatgaatctgggtgctcctgtattgggtgcatatatatttaggatagttagttcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctatatccagtttgccagtctgtgccttttagttggagcatttagcccatttacgtttaaggttagtattgttatgtgtgaatgtgatcctgtcattatgatgttagctggttattttgctcgtcagttgatgcagtttcttcctagcctggatggtctttacaatttggcatgtttttgcagtggctggtaccggttgttcctttccatgtttagtgcttccttcaggagctcttttagggcaggcctggtgctcacaaaatctctcagcatttggttgtctgtaaagtattttatttctccttcacttatgaagcttagtttggctggatatgacattctgggttgaaaattcttttctttaagaatgttgaatattggctcccactctcttctggcttgtagagtttctgccgggagatccgctgttagtctgatgggcttccctttgtgggtaacccgacctttctctctggctgcccttaacattttttccttcatttcaacgttggtgaatctgacaattatgtgtcttggagttgctcttctctaggaatatctttgtggcattctctgtatttcctgaatttgaatgttggtctgccttgctagattggggaagttctcctggataagtcctgcagagtgttttccaacttgtttccattctccccgtcactttcaggtgcaccaatcagatgtagatttggtcttttcacatagtcccatgtttcttggaggctttgttcgtttcttttttttcttttttctctaaacttctcttcacgcttcatatgattcatttcatcttccattgctgataccctttcttccagttgattgcatcggttactgagccttgtgcattcgttacgtagttctcgtgccatggttttcagctccatcaggtcctttaaggacttctctgcattgattattctagttatccattcgtctaattttttttcaaagtttctaacttctttgccagtggtttgaacttcctcctgcagctcggagtagtttgatcatctgaagccttcctctctcaactcatcaaagtcattctccgtccagctttgttctgttgctggtgaggagctgcgttcctttggaggaggagaggcactctgatttttcgagtttccagtttttctgctctgttttttccccatctttgtggttttatctacctttggtctttgatgatggtgacgtacagatgggtttttggtgtggatgtcctttctgtttgttagttttccttctaacagccaggaccctcagctgcaggtgtgttggagtctactggaggtccactccaaaccctgtttgcctgggtatcagcagcagtggctgcagaacagcagatattggtgaactgcagatgctgctgcctgatcgtacctctggaagttttgtgtcagaggagtacctggccgtgtgaggtgtcagtccgccccgactggggggtgcctcccagttaggctactcgggggtcagggacccacttgaggaggcagtctgcctgttctcaggtctccagctgcgtgccgggagaaccactactctcttcaaagctgtcagacggggacatttaagactgcagaagttattgctgtcttttgtttgtctgtgccctgcccccagaggtggagcctacagaggcaggcaggcctcctggagctctggtgggctccccccaagtcgagcttcctggccgctttgtttacctactcaagcctgagcaatggcgggcacccctcccccagcctcgctgccgccttgcagtttgatctcagactgctgtgctagcaatgagtgaggctccgtgggcataggaccctctgagccaggtgcgggatataatctcctggtgtgctgtttgtgaagcctgttggaaaagtgcagtattagggtgggagtgaccctattttccaggtgccctctgtcacccctttctttgactaggaaagggaattccctgaccccttgcacttcccgggtgaggcgatgcctctccctgctttggctcatgcacggtgcactgcacccactgtcctgcacccactgtccgacactcccctgtgagatgaacccggtacctcagttggaaatgcagaaatcacccgccttctgcgtcgctcacgctgggaggtgtagactggagctgttcctattcggccatcttggctccacccagtttttaatatttaacttcaccactgagtcagaactgaaacagttggtacggaggcctgtgttagtgagactttggcttgccacaaaaccaccctaattgaagaaatgaaaatctgatgtccaagtaagtaatgaagccaatttgaataaagttatttatgtgattgcaaattttaaaaagaacctacgaacgaatacttaaaaaaaaatttaaggtagtgctgtgctttgaatatgtccttcaaagttcatgtgttggatactcaattgctgttgtaacaatgttgagagttaggacctttcagaacagattaggtcatgagggctctgcctcatgaatggattaatgctgttattgtgagactgtgttagttatcatggcagtgggctcctgataaaaggctaagtccaaaccccattttctctttgtctcacacactctatcaccatgtgacaccttcaatgtaccctgccagatactggtgccatgctcttgagacttcccagccgccagaacagtgagccaaataaaattgtcttctttataaattgcctagcctgtgcattctgttatagcagtagaaaacagactatggcaggtaggtagacatattacccaaagagaaacacatctgaaaaatatacaccaatctttttacattgaatatgtatgcatcacagtgatgggatcatatagatggaagatgtagaatgatttcatcttctaaatatacatttataatgtttagtattttttaattaggaaaatttcttgagagaaacacttgaaaatatgtaacagcaaattaacaagaaaacacataaatatttttattttaagaagcgttcatgctatgctgtttttttttaaaagaaagattataataactcttgacttgagagttacccctatctgtgtaggtgtgtgatttgtatattacagttccatcatttagaatgttcaaactctcaatgtgcagacttatcttctgctctctcaggggttggatgtcctctctcagggcatagagacacaataagggattgctgttaagggatggacaattatagaaatttctggttgatgcactgcatatcagtcccttttatcactcccttccccttgcaagctgatctgtcctgagacttttggggttataagtctgactctgacaaacaaatagcatctttgtacattcaatactttaaaaggaaaaggtgtgattctttttttctactcccattccagtggccactaaattatctttcctatttcctttatactttccatgtctgtctctaatatgccctctctgagatggactgcactttttttttctgtcattcagttattttcagatatttttgataactttgtccttccttaagaatatgtgatgcgcaagagtttattaaaactatgtgtggtgaaatcatgcccatccagtagagctcagttctaatgctggcaatttcatgtagcatctgaatgaaccctgacaagcttctacaactcattaagtctcagcaacctaagacaggccaagaagctggtaattctgcctaccagaatcccgttatgaggaacacatggaggaagaaaatgtaatgtaatgcagcaagcacagagcatggcatgcagcaggccctcagagttcccccatgtccgtagctacgagtacctgggttccgggtctcccgactatagttagcttgctctgcaggggtgactcaattggaaacagctccctgggtgttggtggcaaactcagggggcactaagaacaggaagtagagtctcttctggctcccagggctctcctcactatgcccttcgggaaaggacttattttgaaaactccaccttgctcacgtgagcctgacaaaatggtctgaggcctactcttgcctcgtttgacagatcccctcaattttctctgaaccccagctccagatctcacagattctcctcacaaacaccatgtgaagacagtggtgacaggtcactacccacatgccacaccatgggtgaattggtcagtgccaatccttggcctcaggatctcacagggcatgaagggttctgggccccctctcccactccaacccccaggacacccagcagactcactttcagttagagctggtaggtggcaagggcccaggctgagtgttttccattgtcctgaggatgagggcaaagtgaaccctgagatacctgtcttagtccattttgtgctgttataagagaacactcaacactgggtgtgttagtctgttctcacactgctgtaaaaatactgcctgagactcggtaatttataaacagaaaaggttcaattgactcacagttccacatggctggggagggctcaggaaacttacaatcatgggagaaggcgaaggggaagcaaggcttgtctttcatgatggcaggcgagagagagagcgaggaagcgccacactttaaaaccatcagctctcgcgggaactccatcactatcgtgagaacagcacggggaaaaccgcccccatgatccagtcacctcccaccaggtccctccctccacacgtgaggattacaattcaacatgagacttgggtggggacacagagccaaactgtatcactgggtggtttataaagaacagcaatttgtatcttacagttctggaggctgggaagtgcaaggtgggggggcttgcatctgatgagagccttcttgctgtgtcatccaatggcagaaggtgggagggctagagtgcacaagagagagaaagcaagagatcaaactcatagactcaagcccttttataattggtattaatccattcctcaaggtgcaaccctcatatgacctaaacacctcccattaggagggagggttgcactggggattaagtttccaacacatgcttttttggggacacattcaaaccaaccattgcatcctgcccctggccccccaaatttatgtccttctcacatgcaaaatacattaattccatcccagtagccccaaagtcttaactcactccagcacccaaagtccagagtctcatctaaattagagatgggtgagactcaaggcaggatccagactgaggaaaatttcctctagctctgagtctgtgaaatcaaaacaagttgtctattcccaaaatacagtggcgggacaggcgtaggatagacattctcattccaagagggagagacaggcaacagaaaaggcataactgatcctaagaaagtccaaaacccatcagagcaaacaacattaaattttgaggcttgagaataatgttcaagttctgccttctgaggcagggattgggcccccagattctcaggcagccatgcctctatggctttgctaggctcagtccacccagcagctctcacaggttggagtcttgttcctccagctctcccagggtatcattaaatgccagtagctctgaaattctggaatcttagtagcagtccagctcccacacctctactagacattacccgaattgggactctctgcaactgacttgttcccacagccccatcaggtactggcctgatggggactctctctggcagctctgcccctgtggcaggtctctacatgggtcctcaggctgtctgcaacattctgcgaaatctaggtggaggccgtcacagacccatagctcgtgaatgctgtgcacctgcagaatcagcaccatttggatgccgccaaggtccaccgcttgagccttccagaccggcagcctgttcagcacccggccccccttgaactatggctgggacagccgaggagtgctgcacgaaggtgcgggcagcagacacttaaaagcatcacggggcagcagatgttgaggtcccgtgggcgtctctctggaaactttgccttcgcattgtgcactgggcatgtgactggaggagcagcctggaaaactctgaaatgccgtcagggcctttctccagtggtctttgtcttactgaatagcacctgtttcccttctagccatggtaatctcattagcaaagtggtcacttggccatgtctgtagtttgcactcctaaacacgctttttcattctttacatggctagggtgaaatttttcaacatatttaccttcttcctatcttttaattgacaaattccatctttaaagcatttctctcttctctcatttttgtctaagtggccgaacaaagtcacgcagtaccttgaatgttttgctgtttagttatttttactgccagatatcctagttcattaccctgaagttcttttaatttttttcatttttccatttttgtgggtacatagtaggtgtatatatttatggggtatatgagatatgttggaacaggcatgcggtgtgtactaatcacatcacatcccctcaagcatttgtcatgtgtgttacaaacaatctgtatcctcttaggtactttaaaatgtacaattcaactattactgactttaggcaacatgctgtgatatcccaccttattcattctttctgtatttttttgcatccattaaccatccccacctaccccctgcctccacactacccttcccagcctctggtaaccatccttctactctctatgtccacgagatcaatcgttttgattctcaggtcctacaaatcagtgagaacatgcgatgtttgtctatctgtgcctggcttatttcactcaacataaagatctccaattctatccacgttgttgcagatgactggatctcattctttttacgactgaatagtactccattgggtatatgtagcacattttctttatccactcatctgttgatggacacttaggttgcttccacatgttgctattgtaaacagtgctgcaacaaacaggagtgcagatatctcttccatatgctgatttcctttcttttgggtatatacttggcagttggattggtggatcatgtggtagctcaaattttagttttctgaggaacctgcagagtgttctccataatcgttgtactaatttcattcccaccaacagtgtacgagggttcccttttctccacaccctcatcagcatttgttattgcctgtcttttggatataagccattttaactggggtgagaagatatctcattgtggctctaaagatcagtgatattgagcacctcttcatctgcctgtttgccatttgtacgtcttcttttgagaaatgtgtattcaaatcttttgcccattctctaaccggattattagattttctccaatagagttgtttgagctccttgtatattttactggttattaatcccttctcagatgggtagcttgcaaatattttttcccattttgtgggttgtgtcttcactttagtggttgtttcctttgctgtgcagaagctttttaactagtcatgcatgatcccatttgtccatttttgctttggatgccagtgcttctcgggtattactcgagaaatttttgcccagaacagtatcctggagcgtttccccggtgttttcttgtagaagtttcataggctgacatctcagatttacgtctttaatccattctgatttgatttttatataagatgagagataagggtcaagtttcattcttctccatagggatacccagttttcccagcaccagcgccatttattgaagagactgtcctttttccagtgtatgttcttggcacctttgtcaaaaatgagttcactgtaggtgtgtggatttgttcctgggttgcctattctgtcccattggtctatgggtctgttttaatgtcagtaccttgctgatttggttactatagctctgtagtataatttgaagtcaggtaatgtgattcctccagtgttgttcgtttttgctcaggatagctttggctattctgggccttttgtggtactatatgcattttaggattgcttttcctatttctgtaaagaatgtcactggtgtttttgtagggattgcatcaaatctgtggattgctttgggtatgatggacatttaaacaatattgattcttccaacgcatgaacatggaataactttccattattgtgtcctcttcgatttatttcatgaatgtcttccagttttcattgtggagatctttcacttctttggttaattccgaggtatttaattttatttgtgtctactgtaagtgagattaattttgatttctttttcagggtgttcactattggcatatataaatgctagtgatttttgtaggttgattttgtatcctgcaactttactaaattggttgatcagttctaatagttttctggtggagtcttaaggtttttctaaatataagatcgtatcatcagcaaacaaaggtaatttggcttcttcctttccagtgtggatgctctttacttctttctcttacctgattgcttgagcaaagacttcccgtactatgttgaataacagtggtgaatgtgggcatccttgtcatgttccagatcttagaggaaaggctttcactttttccccattcagtatgatactagctgtcagtctgttgtatatgacttttattatgttgaggtatgttccttccatacccagtttgttgaggaattttatcaggaaggaatgttggatttttatcaaatgctttttcagcatcagttgaaataatcatatggtttttatctttcattctgttgatgtgatgtgtcacattgattgagttgcatatgttgaaccatcctcgcatcccagggataaatcccacttggtcatgatgaacgatctttctgatgtattgttgagttgggtttgctagtatttagtggaggatttttgcatcgatattcatcagagatattggcctgtattaagaagtcactgtaagaagatgcctgagagtggatacttggtcagtgtaatgattttaatatgcgccttttctattcttcagaaaatagtctcctttcttatttactttagaatgtcatgacccccaacctatggaattaattaaacaagaaacatttccaatacactatttcacattcagaaggtttcacagtctttcagtgtcaaaccttgtgagcaaagccagggcaacaggctctaagctgacaaaaaagtttaccagtatcttccatagagatggccttttcattcatatagattccatcggcaagtcaggccagacctttcagactctgacttgtaaaaaagtcttgtgtaaggaaaacttaccagtttgcaactagtgtttggtcactgctgagagaaacaaatattaaaaaataaataaatatgtctcagagagttaaataggcatacttggaaacacgaaagcttggaaaatgaatttaatatggcagattttattgagaatgcatcatgagtcataggagttcagaaatcaggaagttcaggaagaagaaaaagatcacaaaggcaagtttatgattacacctactaatcgaggaactgcttgctctgcaaccagtagatgatcacgagatggtcagatcttggtaggcccacaagagatgtcaaaataaaattctcaaaaataaacatcctagagacctccagttctggccaagctggagtttgccctttcctcccagatggtccctctacatcagaacaccctgaatataacagcaaaccagcaaagaaagctctgaaacgtggaaaggggaaagcagaccgactcatgctctcaggactcgagcaagaacacaggcagcgcattcccttggtttttctatttccacccaatatcccagacagggcaccgcagaagcccccagtccagaaccaccaacaatggcagacacaaagctccaagaaaagcctatttcctctgccaaaagaccataaaaaacgtgatctaaaaactgaaaaacctttgtgacaaattcccctcccctacactagacaaacaacaatggaaaaaccttatctcccccaccccccaaggtttcagggaacaagaaggaaacttgtcttctatcctgcctctctgaggcagatggtgatgatccaattcacctgtcagggtagtgtcagtggtgtccagcagcaagatgagccttcaccttcacctgacatcaataacactgaacaaggcagtccaagttgggactagtaagcattccatttatccccatctctggtgtcagtgatgcccagtggaaagttgaacctttacactcatccaaactcaatgaagtggtgtgaggcggggctaatcgacactctgctttcccgctcaggcattctgtgcaagctaggccctatggagagctgtgcctcctcatccacccatcatcaagatggaatcaggtggtgggaggcagggtttgttggcagtctcctttccccctccttcccctgatgttctcagagaccagtggggacctaggcttctgccccaccacactgcagcaacaaaactttgagtcagccatccagttcccctttccctaaagcctagcaaagaactgtgcctatactccccgaccccacctctgaggtaacaaagtgtggtgaattggtgcccccttttttattggaaatgttctcaggggggctagggtagaagttcagctcccacccccagccatctgtgaagaggcaaggtgaaccagcaatctagtttgctaggatggtatcagaacaggaatctgcacttatcaccttatgatatgatgggaccaccatcatatatgtggtctatcattgaacaaaaagtcattatgtggtgcatgactgaatatggactatcttaatgaaatgtcatcacagccttatgaggttaaattttttactattcccagtttaaagatggataataaaagcttggaagagtttacctggccaaggttatttagctacaaagtggtaatgccacggattcaatcctaagatacctgatgcccattaccccatctactgaaagatgacactgtactgcaaaaattaaaacagacatagctgatctgcttctttacctgtaattagagtaaaagaaaacaacaaaagaaaacaaaaacaacacagtgacatgctaactgtcatgaagaaaagtaccacatgtctgataaggtgatcagagatgtacactaagtaaggaaggtagctatagggatatctaaagccaggctgttacagaaaaacactcaacggtatgggagtatgcttgctgagctagtgttagagcaacaaaaaggaggctagtgtggctggagaaaaatccatttattcattcaaagtatccactgaagcaggcattgttataggcacttagggtacattaatgagcaatagacaaagatatttgcccttctggaatttttatttttccaccatgggagacagacaataaaaaacaaaaacagcatatgattaaaatatattgcattccagaagatgactgcgggggggaaaaatcaaatagggaagaagtggaatcaggagtgtgggctgagggttggacattcaaacaaatattggctgctttgcaattgatagtattattagatgggtggaagtcttctcctttgtgccgcctttgccaggcatcagtgtaaatgctctgttggcttcactgcagaggacaacacatttttcctatctttggtcaggactcagttccttctttaatatatcagagaaccagagacactaatatctgacagccttttgccatcaagtggccatgcgttttttaagtaagcatcccctgctacacgtccactaaatttgagcttttaactgtctgtgttgagacgtggcctggtagaaaccctcgctggggccaggcgcggtggctcacgcctgtaatcccagcactttgtgaggccgagtcgggcggattacgaggtcaagagagggacaccatcctggctaacatggtaaaaccccgtctccactgaaaatagaaaaaccagccgggcgtggtggcaggtgcctgtaatgccagctactcgggaggctgaggtaggagaattgcttgaacccgggaggcagaggttgcatgagatgggatcccgccagtgcactccagcctgggcaacagagcgagacgccgtctcaaaaaaaaaaaaaaaaaaaaaaaaaaaaagaaaagaaaagaaaagaaaaaaaaagaaagaaagaaagcaaagaaaccctggctggccagtgcccaggccatacacaatggcattgtgcctcacttttcacctaagacgaaatcagcgggtggggcaggcttataatcagaacacccctccctttccacctcacacactcccacccgcctgtcccacaatccttcctgcccctcccgctctcccacccttggtttctcgaaaccccttctccttccctgccccccgtcccccgagccccaggagggggaggggcaggaatctggctccgcctcccagtatggagatgattggtcaaaggaggtcacctgaccaagctgagccaattgaagtcctctccccactgctttgagaaggaaccgttaagacgctgggccccacccacaagattgcgtcttgtttgtggcaagattctgaggggaagtgtagctcccaggttggttccaagtcttcttccaattaggtaaattacaacaatatcttttccataaatttcctttcttttcttttttgcctttttttttttttttttttttttttgagacggagtttggctcttgttgcccaggctggggcgtaatgtcgcgatctcggctcaccacaacccccacctcccgggttcaagcgattctcctgcctcactcccaagtacctgggattacaggcatgcgccatcatgccaggctaatttttgtatttttagtagagagggggtttctccatattggttaggctggtctccaactcccgacctcaggggatccaccgcctcggccttccaaagtgctgggattacaggcgtgagcgtccgtgcccggcccttctataaattttatataaactaggccttttttggcctacattacctagggtcaaggtttagggattcataggaaaggcaaatccggctggattgctcagtggtccactctccagtccactctctatgtatcccttatcttcacgtgtgattaggttcaattgtatggctaatcacttcatgttctctctttgcaatttctcaggcaggttttctcttcttcttcagaaagttatatttctcttttgcatcttagttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagccactgattttgtcttttaaaattctttactctgaaataattttagacttacagaaaagttacaaaaatgattatacagagagccctcgcctggatttccttaatgttaacatcttatataaccatagaaaaattaccaaaactaactactacattacattgatgcactaattgacattactacatcgatgttaattaccaacagttagcattgatgtagtactattaactaatctacagattttatgtgaatttcaccagatatctcactgatgtcctttttctattctaggatcttatccaggacgcttcattgcatttggtcttcatttctccttagtctcctccaggctgacatttcctcaatctttattggtcttccacagccctgacacttttggagataccagtcaggtattttgtggaatgtctctcaatttgtgtttgtctcatgttttcttatgattagattgaagttgtgcatttgtagcaagcacacctgttttattctcctccctttcccagtggcgagggagggattcccaccctagtgttatgggggcggctgaacacatggtaccctatactggacagacggaatccacagcaatttatcagtaacatttactcacaactggagagaggagggcacctcacgccaggtagagccacacagtgtcacactctggaagagagtgaacaagcaggggctttcagggggaagtctttgtagtaaccagaggatgaagtgaccgttggttcagggtaggacgattggcttgtttgaataattctgcaggctggtggggacctgaaacatgctacccagagataagcaggcactgtgtctgttcaacatgataataaggagggtactttggccagggggcctttctccctgggaacccaatagggaagataacttgtggtgaggccattcagggtcctcctgttctaccccagatgtcaaggcatccatataattggacctctaattttaggtcttatgcgacattaccgcaaacgtgatttcgttcccttctatgtggatcatgtcaggggtacatgacatccataagttgtattactggtggtgctcaccttgatcacttggttaaagtggtgggagttatgctgccccagtgtaatgctactattttcctctttgttagtaataaatatagtgtgaaaagttctttaagaagaaacacaatagatcctcttatattcctgtttcttcgcagactttgacccactactgttaaaatctgtctagggatcttgcctacagcaaatattacctaatggtgattttctgttttcctaatttctgctacatttattaattggaattcctctgtaaggaagagctatctttactccctcattcatttatttcttcaatttatttatctcagtatgggctcttgaataattatgttatacatgccaggcttaatacctaggtgatgggttgatgggtgcagcaaaccaccagggcgcaggtttacctatgtaatgaacctgcacatcctgcgcatgtatcctggaacttgcaataaaataaaataaaaatttaatctaattatatcattattttgttctttgaactgttctagccttggccattgggaagtcattttggttggttctgtggtcttttgatatgaccctatccttttttggtacctttttctggcacaataagatgttcagattcagcatgtgtgtgcccccctcccctcacacacacacaccccttatagccctggattaaaacaacttctacgaggagccccggttccctttcttggggaatgatatttaccaaccagtatctcggtgtgtgttcattattaatggcgtttcattgctgctaaggctctctctatggagagggttaggaaataatgtatgtatacacccatgcctatagacacatccacatttattttggtatctatctgtatgcatagctattaaaagccaggagcttgtattgatactttcaattccaatcattctagacttatttgtagattcgttctccgacctggctttcattatcaaatagtttacatacctgtttatttctggtcagtagatacataaagtagcgcctgaattgctaacaaatgcccctgttgcaaacatattaataacttatatttttgtacagttgtttttgtctttggccttagaggatatagtcaaaatactgctctccaaagttatgtatcttagatcttttcttcctctctccttcagcgtggttaagacactcatttgtaatattgttagttgaacctgtttctgtttgatttggggtaccctcaccccaatatcccggttgattttaattttttatttatattttgggtatgtgcatcattactatgatccaaagagtcagggttatacaaaaacctatactcggagaaatgtcactccttcgtcatcccttctaccctgttcccattccccatttctttccacttctttccctggccctccctgtagggtaatcagcccctttggtttctggtttaacctttcctgtatttattttgcccaaatgagcagatacatacatgttttctcatattcctttcttacacgaaggatagcatactatacatgttcctttgcactttgcctttcctacttaacagcattcttggaaatcactccatattgtttcacagagatcttcatcgttcgtttttacagctgcattgtactccattgtgtggctgcgccacacatagtttattcaaccactcgcctatgtttgggcattttgtttttaatacagaaaccaggtctcgctctataacccaggctgactgaagtgcagtggcacaatcatagctcatggtaacctcaaactcctgggctcaagcaattcacaactgcctcagcctcccaagtggctaggactacaggtgtgtgccaccatgcctggctaattaaagactttttattttttattttattttttgtcgatatggggcctcgctatgttgcccagactggtctggatctcctggcctccagtgatcctcccgccttggtctccaaagtgctgagattacaggcatgagccatggtgcctggcctgtatgggcttttaaattccttccaagattttgcagttacagacattactcccgcgaataaccctggacatgattttttttttttttttgtattggtagaaatgtaccttcaaggtatattcccactggtaggattattgggccaaaagttaagtgcacatgtagttttcttaggtgtttccaagtttctctccagaaggattgtactggttttcatttccattagcaatatatgagaatgacaatttccccacagcctcactaacagaacatgttgccttacttttgaaacttttttctacgggttaggcgagaaatggtgtctcgctgtttctgtaatatacctttgtctaactatgagcaagttttgacacttaaccatatatttgaggactgtttttatactttttgttggaattatctgttcatatctttcccccatatttctattgctgttgtggtccttcatccctcaatatttaagagctctctatatatttggaatattatccagttgtctgcgatatgtgctgcaagtactttacatcaatttgtcagttgccttttgatttatttatgatgcatttgcatcactttcgtttatccttatgtggtcaaatggattgattatttttttctttcattgcctccggaatttgaatcctagttagaaagcttttccctacagtggggttctgccatgttttgttttgttttgttttgttttttctttcttttctttggttgacatggagtctcgctttgtcgtccaggctggagtgcagtggcgcgatctcggctcactgcaacctctgcctcccaggttcaagcaattctcctgtctcagcctctcgagtagctgggattacagccgcccgccacctcgcctggctcattttcgtatttttagtagagacggggtttcaccattttggccaggctggtctcaaactccggacctcaggcgatccacccgcttcagcctcccaaagtgctgggattataggcgtgagccacccccctcccccggccactgccatgttttcttcaagaacttacatggtttcatttgttatgtttagatccctaacccatttgcagtttattcttgtgcatgctgtgttatatggatctacctttatttttccagacgtctcagttgttccaggaccatttattaaatgtccatctttgccctaaagagtttatgtgccatctttatcatgtactaactgtcatatgatttggttgtatttctgagttttctattctagtccactgggctattagtctattcttgcaccagtgccacaatgtcgtaattacagaggctttatagtgtgcttttctggctgatatcataagtcccctctcatagattttctttttcacgtgtttcctggctatgcttgcatgttttcacaaatatattaactttattatcaatttgcctaaatgcataaaaatgtgtgctggcgtttttgcgactgaattaaatttatacaccaatttaggaagaaccgacatctttttaatgctggattattccatctaggacagtgacgtagtctgtttgggctgctattacaaaataccatagactaggtagtttataaacaacagaaatttatttctcgcagctctggagactgacaagtccaagataaagattctggctgatttggtgtctggtgaggaccctcttcctcatcgatggtactttctaattgtatcctcaacatggtggaagggacaaggcagctctctgaagcctcttttatgagagaactaatcccattcataagggctccacccttatgacctagtcgcctctcaaaaggccccacctcctaatggcatcaccttgcgggtaaaatttcctaacctgcacattgtgcacatgtaccctaaaacttgaagtgtaataataataaaataaaataaaataaaaataaaaataaaaaatttcaagatagtaattttgggggtacacaaacattcagaccatctcagatagcgtatgtgtttccatttgttcaagtcttctgtggtgtcattcaggcatatttaaaaatttttcttgtataaatgttgttatcaagtttattcctaaactttaatccttgttgctagtgtatatggggctttgtctgtgaatgtatcctccagctgcttattttttgtgtgtgtattaaaagactgctgattttttgtatgttaattttatattttgctaccttaatgacttcttttactggttcagttgatttatcatcgtttctatagggtttttcaggtatactataatatcatctgcatgtagagatggctttacttctctttgtaaaaagtaagttttattgtgtatatctaaggtatacaacacggtgttatgggacacgtatggatagtaaaatagttactatagtggaacaaattaacataacccattatgtcacatagtgacccatttttggttttggtagcagtaggcgctaaaatctattcatttagcagaaatcccgcatcatacttaatagtacaattgtacaaactgtattccagcatgttgtgcactagatctctagtctctttcatcctacatatctgctactttgcatcctctgacctacatctcccgctttcctcctcccatcccctcctccccaccccgaccctgataaccactgctttattctgtatctctgtatatttgagttttgttttacttttatttttttaagattccacatataagtgagatcatgcaatatttctctttctgtatctggattatttcactattatttcattgttatagcataatgtcctccagattcatccatgttttggcaaatggcaagatctcctttttaaagtgtatacatacaacacattttctgtatccatctgtcccttgatggacacctaggttgtttccatatcttggctattgtgattaatgctgcagtgaacatgggagttcagatacttttcaaagatcagctactttcaaaaggtggttattttatttcctttaagtagatacccagaaaagcagttgctgggtcatatgatagttctctttttcactaccatatttttttctaaaatagaaaaatgtagaactaccattttatttactaaaacagaaaaaaaaaatctatttctttaggtacctccatactgttttccataatgattgtccctatctacattcccatcaacagtgtacaagggttcccttttctccacacactcggcaatgtttgccatctcttggctttttgataatagctatcctaatggttgtatggtgttgcctcatagtagcttttatctgcattttcctgatgattaatgatgttgagcactttttcatacacctgttagtcagtgtgtatgtcttctttggagaaatgtctattcaggtcctttgcccgttgtttaaatttgattgtttttctgctatggagttgtatgatttccttacaaaatttggatgctaaccccttattcatatatatgttttgcaagtatttgctctcaatgtgtaagttgccatttcattttgttgattgttccctttgctgtgctttttagttcttcttattcattcctaggaaaatgatctatttctctgctcagttgactaatacttgtaatgcaagattgaataggtgtgaggtagtaggcatgctttccttgttcctgatcccaagggaaagcttcgagtgcccccccaccccattaaataagttactagcattaggacttaggtatatatgttttatcatgttaagaaagcatcctgtggtgcctattttcttaaggcttttctattttttaacataaagaggtgttgaatttttccaaaggctttttcaacatctgtggtgataaccatatgatatttgtctttaagtatattaatatggtggatgatatcaaggtactttctaatattgagccaatctgtattgatgggataaatcccactttgccaaagtatattatgattttttaaatatgttgtttgctaatattttatctagcatttttgcatctacacttatctatccatgtcacacttgcttcataaaggaagttatgaaaatttcctttataatgctgttgaataatttatagagcattggcactctggtactatctgatctttgaaggtttagtagaattgacctgtaatagcatctgagccaggtgcttcttgggagttattccttaataactttttccatttttttctgtaaaaattggccaagttaagccttccagcattagagtaaaaatcttgataatctgtattttcctaggaaattatttatttcatgtgtatttttaatttctttatacacaggtttgaaaagcaacctaattttttctgtttaaatgattatcatttgtcgtttattattttgtatatttgtgctctctccctttcttccttcattaatctgcctagtgagtttgtccattaaaaaaaaaaccaggattttgatttaataaatatacacacattgtttttctactatgtatcttattaacatctgcttatgtattcattcattcattcattcattcattcattttaatgaccgaatctccctggatcactcagtctggagtgcagcgttgtgatcacagctcactgcagccttgagctcctgggctcaagcaatcttcccacctccgcctcctcagtaagtaggactacaggcatgttccatcacgccctgctaaagaatcattattattattattattactgtagaggcagggtctccttatgttgcccaggctggtctcaaacgcctggcctcaagtgatcctcccgcctcagcctctcaaagtggttggattacaggtgtgagccaccaagcccggcaatttctgcttttatgttatttctttatttgtgtttcttttggtttcccgggttgttcttttattagatttttgaggcagtgctttaatttgtctaattttattcgttcattttcattgatgagagtatttagcgctctgaatctgcttccaatcactgctttaactatcttctacagagtctcatatgtaagctcttataatcactcttcttaaatatttctgtaacttcagttggtatctcgtctttatctcgacatttgcttaatagaagactgaacattttttccaggtagaagagcctttgtgctttcagtttgtgttagtaagttctacttttgttgcatcgtgattgcagagggttggttgtaatatttctactttatggaaattagcgaggccttcactgtgaggtaattatgatcacgttttgttaacgtgccatcagcttttgacaaggtggtatattctttatctccaaggtgtagatttatgtgtgtgtatgtatgcctatgtgtgtatacacacacacaatgtatcttattgtgttgtttacattttcggtataggtctctttattgtaccactggatttgccttgtactgagacttgccatgtattaaatctcctattattactgtgcttcaatgtctccataccttttggcattacaaaggtggttcctatgttatttggtgcataagtattcctaagtattatatattcactgtgaattttcaattttaatgttagcatgtaaactttgtcattaaaaaaattacttttagcacctgctttcttattgaacattttactatctggtccactagtttgtttttaacccccagtctccttttaacactcatctactgccttatgaaaaaaaaaaagtttattctctttttctttctatctctctcacttctcttattttacttgcactatttctttttttccacaatataaaataaatgcacgttagtcattttccttgcttcaccttcattttagtattagataccaaatgcttgccatcagatgttgtagggaagattttcctgtcgttacctgtggaatcacaatcccagtttaccctttagaatataagttagcaaacgttttctgtaaagagccatatggtaaatattccaaccagtgggccatagtttgcagacccttgctctagtggagtcctcaggaagggctgatgggtacataatttcctaagttcctgtctgtttttctataagctgtgatattagtgaaggatcggctgagctggatatcaaatcagtacttcagacgtttttctcagcccatttctgagtttagagttttaagtaatattctaattcaaggcaggttttatatcctcaaatgcttgtttgaatggaattaattctgtttgcagggttgacgtacagttccttctgtttcatggttgtttaatatgtgtgaaatttgtcttctgctctttttctctttctggaatgtttttgtaaggaattatccttccttttgttcatttttatgatattggattgttttaccagattcctattttacaggtgctattttctgtcagtgtagaaaaattcaggcctgaaatttactgatttcgtttgcttgttttggtagcggacaaagaagttatgagtgctctgattctgtggttctcttatgtcttgcaagattcttcattttccccttttgtttcttttccccatcattaccaaagtggcaaagcatgcttctccctttctgtttgcccttactcttacccagaagctgtggatttcaaaggctacttttattttattttattttaatttgagatagagtctcgctctgtctcccaggctggagtgcaggggtgtgatctcggctcactgcaacttctgcctcctgggctccagcgatcctcccacctcagcctcccgagtagctgggaccacaggcgcacaccaccacacttggccactgttttaagttttcgtagagacgaggtctcactatattgcctaggctggtctgaaactcctgggctcagtggtcctcctgcctcgggcctcccaaagtgatgggattacaggcatgagccactgcacccaacccaaagactacattctaagatcatctctacccctttaaattacacgtattttagaggtccttccctgtagtccctgctcttattatctgggacacctttttggtatttttttagacttagtctgggctcagtcattttaactgtagtttcggaccaactttaagtcccttgcctcttcctttctctgtgtctcttgcagcttttcttggtctgtctttgcttgccacaaagactagtgatgagagcatgacagatcttgtgctgggatttcatgccttttctccttttactcactactaaagatttggcattatctgtttctaagtaacgatgaggatgtggcttctgtatagatttacatcttcctttctgattggtttatatccttttgacatgaaacattgggaggcaggtgcctgggtggtcgacattgccttatgctgacttacagctgatttcaaatggcattttatcttatctaaatacatatgtgtgtgtatacacacacagacagacagacaccacacacacacacacacacacacacacacacacacacaccaacacagacatttatacacacatacaagtctatttgtattccatgtctatagtagaggtctcttgaagtggtcgtttgatttaccatatatttgttcaatacatatttcatttattgctatctttggtggcaggcaagagactgtgaaaatcttctcaggatttgttaatgttcctcaccctaaagcaggttcatgtcaatggaccaaaaggtgccagccacactgctagagctcgctgcatggagtctgctgagtgatgagcctgcagctatccatgctcttgaggagctcccatgagacctctttgttccattgttcatcactgccttcttgggtgggcagaagatgaaactaaaggccatggtgaggatttggccctcccgttgtctccatgttggaccgttgagtgtaagggagtcacactatgaaatcttgggagccacgattgatggtcctgcagatcctccctgcccagagctcttcccctcggtaaccctatgtacactagagacatagtgagtcatcaggagggtatgctgcagcctgaggcagggggtggcctaacagtctcccaaaggtggttgacggtgaatgctgaggatctctgtgaggttgttggtccaacacttggggtcaccttaaggactctaatgtcttacagaggtgattatggaatagaggtgattgagagtactattgatggattcacctactgggtatgattacatagaagaacaacatggacaccagactggggaggatcggaggagaaggaaggatgggaaaaacaataaaagatgttgagtttgtacaaaaaaatatttgttggtagattgtttacagagtgaagagcaaagataaagggtttgcccctccttcccctcattgatgttgctgggttatattaaaatcagccacctttcatattctgtctcttcctcttcctgcagacggccaaaacggagggtcctggatttaaagcaggacccagacagcagaaccacatgctctgagatcaggagcacattcccattttgttttcagtcttgcgtttactctcagcactctatcctgaaaatagaagaagccaagcgaagtgttaggtgcctggaaattgtacatttagagtctgagtctcggcccatccagggaacgcatgggattgttagtggacatttcccttgatggtaccttgagaacaaggcaactcttttctttcctttcgagtaaagttgagcagagccttgggtccttgcatctctgctgcagagatttgcaaattcatcaagtgtctgcccacaaaagcgtcctgtagtttctggatctgggatgcactgatcacctggaagtaggtcaggcttgtttgagtgaagtcagcacccttttggcacagaagatccaccaggacagacttagtctatctaaaatccttttaaaatcctgtaaggggagaaacttctcaacttttttcactcatcatgagcagatgaacaacctccaggaactcagcttgtcttgcttctgcctcacagatcagctggacaaaatttccgggtgagaggttggggagggacctgggttccctgaatgccccattacgaacaaaagagtgcgactattcttagatattcttaaacactttgtaacctatttctccttccacatcagcacgggcactgctgggtgttttaaactggccaagctagagagtgtggtccctcatgctgaggagaaagacaggattagaaaagtcagctgtgcccagtcagtcagtcagtcagtcagtcaatcaaccatgtgcagacgtgcagacactaagataagtctgtcgacatattggcgaaaaagacaacagtcctgcttttattggagtgtgtagccttctagagaggaaggggaggcattcagtcggagaaataactgacgctgtagcactgatgcacatccccatgggctggtcacaataggtaataccgccagatcgttttgttcctgtagttttcccgaggcttaggacctgaatggagaacctgtcatttggaaattcgtcaaagggaattctcagtcggctgctttcccagacccatccccatcaaataactgaactagatacactgctaattatactgtaggcactaagttaaattctttttcccttaatctgtcccacaaccctctataataattgctattgtgcacatttgaaagattaaaaaactgtatctcagcgtggaaaagtaactttcttagggtcacaaatctattaagtctgactgtaaagtccacagtgttaactgctgttgcaatggatatacagattactttattctagagtcataagtatctataattcagggctgcttgctctaatccaaccctcattcttcagaaatgccttccttttttctctctacagagccctgccatctcatttgtacacactgtatgtgtctttctgtggactttctaccagagagacatcactgtcctatcccagagctctgaggttacccacctaagactgttgagtctgagtaacaatcagatatcctgggaagtttctgagccattccaggctctgctggagacggtctcagggaccctgcagcatctggagatagacaactgcctgataactgattctactttctctgttgtcatcccagccctgagccactgttcccacctctgtgtccctagctttgtcttcaaccccattacaatgcctgtgctcacgagtcttctgcagcacttaacagcgttgatggagctgaagcatgtgatttatcctgtccctgtccattgctatgaacaatggcaatcacatggcagtttggacatacaagcttgctaaagtgcaggcctcattgaaggtgatgctgcaggcagtaccacagaacgacatgaactagaccacccattctcagtgatcttcacaggacaaggagttgtttcatcactgatgtgtggccactaaaatactgagtgttcttgcctgaagcccaatttgtaaagacacataatgtgccattctgctattccaggaaactggtgttaggaagattggatatgtaactgacctccataaaagaaaaactctaagaaggaaacagcagactttacgaagtcttgtgggtctcttgcccattgtcctctacgtcctccttcttgttactgaccacagtgttgggtacgtgacatgggctgacccagtcgtggcacaccatttccctgtccacactgatcggttcacttatgggtacttgacgcaagtcaggacagttgaaacctttcctggatgtttttctggagtaggtgctggttactgaagccaataatattactcactgaggtcctttaatcttcctgtattcatgattgccttaggttgcttatgacaaaccattggcaattaaaatgaaaaacaagaacaacaagaaacaaactatccccactacctactggtgtctttatcagtatattgctatctcctttcctaggtctcagaagcctggggttcagtttgcccttatttcacacagattcaccaaagatctgttattagctaggtactgttcctggtgctaagaatgaataggcaaacaagaccctacaccaagtcactcacagtacagatcttcctatgttttgtctgtttccccgctcttttcttaggggatttgggaaagttattttgcccatctatggcccagaatttttttttttttttttttttttttttttttttttttttttgctttgccccttgcatactctgctcaatccacattggcctctttatgctgttggatagctcatcaagactcaggccgtagcttagatgttacgtcctccgagaggtttttctcttacttccctctccttacttaccccacttctctcccattacttcccttacttcaccatgctgtttttaaatgtaccatgtacatttccttcatggtacacatcattccatatgtatttgctccctctgctcctcccctagagttgcactattcagtatagtaaacactagccacatgtggctactgagcactagaaatttggctactccaaaatgtgatgtacgataactgtaaaacgcacacggtatattcaagacttagtgagaaacaaaaaatgtagaataactaactaataacttatttgtattgtttacgtgttgaaatgataagttactgcaggtcaaagacagtaaaaaaagaagacagagtactaatgtgtttatattgttcaacatgttgaaatgatagcactgcggcaaagacaatcactctcagcattcctattgaatacctccttggaagacccaaccggtacaataaagcaaaggaaagcactaaaaggcacacagattggaaatgaagtcatgaaaaagtgtccctatttactgacatggtggctatgtataaaatttctgggaatttatgaaaaacctcctagaactaatgagtgagtgtgcctaggttgccgtataccaggtcaatattaaaagtaggtcaactctatttttatatacagtcctccctttgcacagttctgatatgcactaaggtcattcaccgtgatttagttaaataacactagtcccttcacagtatgggtcaaatttcagttaccatggtaaactaactgtcagtaactacataaagaccaaacattgctgctggttcttcagtccacaaatcgctactgaaataacagatgagaatcatgatcagtggccagtcatgtcacttctttcaaattctgtttgtgtcgctccacaaatcactatttaaataatagatgagcatcaggatcagtgaccagtcatgtcacttttcttttaaaatctaatcatgtttggtcactgagtatctattatttatttcatgcatcaacagcaaagaatgaagctgagtttcctccttgtctcccagtgaactactcatatgacattttaccaaagaactggatagtttaaaaaggtaattggccaacaaagacagaaacatgcaaacaaatgacaagaaataatgctggaagtggaaattgcaaaacggttttgatggaaaggattaagatatcccagtgaaagtgacacttgcaaaaaactttacactacaggattccttggagatattcatgacacagaaagaacaaagaataaagttgtggaagctgatcaacactcaaaactgagaaacaaaatttgccaagtcacgggaaaaaatgtctactccatatcacaattaataagatgagaagaaggcaagaactgttcatactactctttttttttccatgagaaattctggatttaattttatttggaatgtcaccaacttctctggcataacatatggtataattatttttagaatgtgattactttatgaatatttgaagacatttttatgttttgagcacttttctgaaacaatagcttctgttttagtgcatagtagtggacaaggccagaattgatgtttttctgtaacattaagctagtaatggtagaagcagttagataaattcaagtcccttgactccagtcacaagacttcctctaaattattgtgactttgtaaaatattcttaatttgaattttttttttattaatccaatagttatttacattgatcttaagtaaaatttgtatgtggcggccaggcacggtggctcacgcctgtaatcccagcactttggaaagctgaggcaggcggatcacttgagatcaggagttcgagaccagcctggctaacatggtgaaaccctgtctctactaaaaaaaaaaaaaaacaaaaaacaaattagtcagttgtggtggcgggcgcctatagtcccagctactcaggaggctgcggcaggacaattgcttgaaacccggtaggcggaggttgcagtgagccgagatcatgccattgcaccccagcctgggcaacagagtgagactctttgtctcaaaaaaaaaaattgtatgtggctacttattgttaatttcactttcattgacatttctactttcacttcacagtgctttaaaaataggcaggccaacattcagattcaggaaatacagagaacaccacaaagatactcctcgagaagagcaactccaggacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgggggccaatattcaacattcttaaggaaaagaattttcaacccagaatgtcatatccagccaaactaagcttcataagtgaaggagaaataaaatactttacagacaagcaaatgctgagggattttgtcaccaccaggcctgccctaacagagcttctgaaggaagcactaaacatggaaaggaacaaccggtaccagccactgcaaaaacatgccaaagtgtaaagaccatcgaggctaggaagaaactgcatcaactaacgagcaaaataaccagctaacatcataatgacaggatcggattcacacattacaatattaaccttaaatgtaaatgggctaaaggctccaattaaaaggcacagactggcaaattgggtaaagagtcaagacccatcagtgtgctgtattcaggaaacccgtctcacgtgcagagacacacataggctcaaaataaagggatggaggaagatctaccaagcaaacggaaaacaaaaaaaggcaggggttgcaatcctagtctctgataaaacagactttaaaccaacaaagatcaaaagagacaaagaaggcccttacataatggtaaagggatcaattcaacaagaagagctaactatcctaaatatatatgcacccaatgcaggagcacccagattcataaagcaagtccttagagacctacaaagagacttagactcccacagaataataatgggagactttaacaccccactgtcaacattggacagatcaatgagacagaaagttcacaaggatatccaggaattgaactcagctctgcaccaagtggacctaatagacatgtatagaactctccacccgaaatcaacagaatatacattcttttcagcaccacaccacacctattccaaaattgaccacatagttggaagtaaagcactcctcagcaaatgtaaaagaacagaaattctaacaaactgtctctcagaccacagtgcaatcaaactagaactcaggattaagaaactcactcaaaaccgctcaactacatggaaactgaacaacctgctcctgaatgactactgggtacataaggaaatgaaggcagaaataaagatgttctttgaaaccaacgagaacaaagacacaacataccagaatctctgggacacattcaaagcagtgcgtagagggaaatttatagcactaaatgcccacaagagaaagcaggaaagatctaaaattgacaccctaacatcacaattaagagaactagagaagcaagagcaatcacattcaaaagctagcagaaggcaagaaataactaagatcagagcagaactgaaggggatagagacacaaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatatcactactgatcccacagaaatacaaactaccatcagagaatactataaacacctctatgcaaataaacttgtaaatctagaagaaatggataaattcctcgacacatacactcgcccaagactaaacctgggaagaagttgaatatctgaatagaccaataacaggctctgaaagtgaggcaataattaatagcttaccaaacaaaaaaagtccaggaccagatggattcacgcccccgaattctaccagaggtagaaggaggagctggtaccattccttctgaaactattccaagcaatagaaaaagagggaatcctccctaactcattttatgaggacagcatcatcctgataccaaagcctggcagagacacagcaaaaaaagagaattctagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatacacaaatcaataaacgtaatccagcatataaacagaaccaaagacaaaaaccatatgatcatctcaatagatgcagaaaaggcctttgacaaaattcagcaacccttcaagctaaaaactctccataaattaggtattgatgggacgtatttcaaaataataagagctatctatgacaaacccacagccaatatcatactgaatgggcaaaaactagaagcattccctttgaaaactggcacaagacagggatgccctctctcaccactcctattcaacatagtgttggaagttctggccagggcaatcaggcaggagaaggaaataacgtgtattcagttaggaaaagaggaagtcaaattgtccctgtttgcagatgacatgattgtatatctagaaaaccccatcgtctcagccccagatctccttaagctgataagcaactgcagcaaagtgtcaggatacaaaatcaatgtgcaaaaatcacaagcattcctataccccaataacagacaaacggagagccaaatcatgagtgaactcccactcacagttgcttcaaagagaataaaatacctaggaatccaatttacaaggaacgtgaaggacctcttcaaggagaactacaaaccactgctcaatgaaataaaagaggatacaaacaaatggaagaacattccatgctcatgggtaggaagaatcaatatcgtgaaaatgaccatactgcccaaggtaatttatagattcaatgccatccccatcaagctaccaatgattttcttcacagaattggaaaaaactactgtaaagttcatatggaaccaaaaaagagcccgcattgccaagtcaatcctaagccaaaagaacaaagctggaggcatcactctacctgacttcaaactatactacaaggctacagtaaccaaaacagcatggtaccggtaccaaaacagagatatagaccaacggaacagaacagagccctcagatataatgccacatatctacaactatctgatctttgacaaacctgagaaaaacaagaaatggggaaaggattccctattttggaaatggtgctgggaaaactggctagccgtatgtagaaagctgaaactggatcccttccttacaccttatacaaaaattaattcaagatggattgaagacttaaatgttagacctaaaaccatagaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccgtcagagtgaacaggcaacctacagaatgggaggaaaattttgcaatctactcatctgacaaagggctaatatccagaatctacaacgaactccaacaaatttacaagaaaaaaacaaaccaccccctcaacaagtaggcgaaggatatgaacagacacttctcaaaagaagacatttatgcagccaaaagacacatgaaaaaatgctcatcatcactggccatcagagaaatgcaaatcaaaaccacagtgaggtaccatctcacaccagttagaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgatgtaaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtagggacatggatgaagctggaaaccatcattctcagcaaactagcgcaaggacaaaaaaccaaacaccgcatgttctcactcttaggtggggattgaacaatgagaacacatggacacaggaaggggaacatcacacaccggggcctgttgtgtggtggggggcacgggggagggatagcattaggagatatacctaatgttaaatgacgagttaatgggtgcaggacaccaacatggcacatgtatacatatgtaacacacctgcacgttgtgcacatgcaccctaaaacttaaagtataataaaaaaaaaaatgacctgttggatttctactttgatgaagttaatgtcatttttaggcctaaaactttttcttttttaaaaaaatcttcaggtgtttttaaattttatttcattttgttttaagttccaggatacatgtgcatgacgtgcaggtttgttatatagacaaacgtgtgtcgtggtttgctgcacctatcagcccatcacctaggaattaagccccgcatgcattagctatttattctgatgttctccctcccccggtgcccccgaccaggccccactgtgtgttgttcccctccctgtgtccatgtgttctcgatgttcagctaccccttttaagtgagaacatgtggtgtttggttttctgttcctgcattagtttgctgaggataatggtttccagctccatccatgtccctgcaaaggaaatgatcttgttcctttttgtggctacatagtattccgtggtgtatatgtaccgcattttctgtatccattctattattgaaggccatttgggttgattcattgcctttggtattgtgaatagggcagcaatgaacatatgcatgcatatatatttataatggtatgatttatattcctttgggtatatacccagtaatgggattgttggttcaaatgatatttctgtttctaggtctttgaggaatcaccacactgtcttccacaatggtggagctgacttacactcccaccaacagtttaaaagcaatcctatttctccacagcctcgccagcatcttttgtttcgtgactttataaaaaccgccattctgactggtgtgagatagtacctcacagtggttttgacttttatttgtctaatgatcagtgatgttgagcttttttttatatgtttgttggccgcataaatatcttcttttgaaaagtgtttgttcatgttctttgcccactttttaatggggttgtttgttttttcttgtaaatttgtttaagttccttgtagattctggatattagacctttgtcagatggatagactgcaaaaatttccacccactctgtaggttgtctgttcactctgatgatagtttcttttgctctgcagaagctctttagtttcattagatcccctttgtcaatttttgcttttgttgcaattgcttttgatgtttttgtcatgaagtctttgcccgtgcctgtgtcctgaatggtattgcctagattttcttctaggatttttatagttttgggttttacatttaagtgtttaatccgtcttgagttaattttggtataaagtgtaaggaaggggtctggtttcagtttactacaggggtctggtttcagtttactacatatggctagccagttctccaagcaccatttattaaatagggaatccttaccacattgcttctttctgttaggtttgtcaagggtcagatggctgtagatgtgcagtcttatttatgagatctctattctgttccattggtctatatgtctgtttttgtaccggtaccttgctgtttcactgtcaagtgctggaaaaagaacaaaaggaactgtctctcattgtcgatggaagtataaaatggccaagacactttgaaaaacaatttggcaggtttgcatgaagttaaaggtacacttatacagcaatcgcactccagggtatttacccaagagaagtgaaatccttcttcccaggaaaccttccagcaaaacgttcttaattgctaaaaactggaaacatctcaaatgcccatcaactggggaatggataaacaaattgtggtatgtacctacactggaagactactcgacaacaagacagttctaagtactgataacataatatgcgtgccacagaatggatgactctcaaaatacattatgctaagtgaaagaagacatactcaaaagactacatacaatgccatttctttggctttatagaaaagggaaaactagagagagaacaaatcaatcagtggttctcttgggctatagaagatcaactttaaaagggcatgagggcactttatggaggtttggacatgtcctagatcttcattcttgggttgatcacatggttgcatgcttttgtcaaaatgcacagaatggtggactgaaaaggggagaatgttatactatgtctcaaaactcggcaccttgattgttattttgtaacctgcctttctccccactgtgtcctgaatcagcaaaaactctatcggttctagggcgtgattcctgctgtaatccccaactctgacagactgtcatccctgtattcctgattctgacctggtttgcctctgatttggaagatatgctttctcagatcctctgccactcttactcattaaccttactcagagcctcctgaaactcactcagtgcaatacaaaggagggatccacagctgcacagaaggtggttgtcagtttctggcttttccatgattcttctgagatgtgttgactaggagtccctgggcttcatccatagattcattctttcaccaaatatgtgttgaacattttccatatgcggtggattctgtcatcatttcctgtttattctccactgcctaacccagaaccagatgttcacgatgtccagttaacaaacgcttctggagcacatatgatgctctaagccctgtgcctggcaccagaaagacagataaattggaaaagaccatctttgtcatctctagcgtcacatgccctccgtggtggacataaagatctattaagcatgtcttttattttctgtgtcgtgatgctttgacatcctgggccttgctgaccctggaaggcttgctcctcccaggcctggtaaggcaattcttagaaatagtaaacaccttgccctggagcgtgcttttcaaatgcaaacaaatcaacggggatacaatacctcccaaccatgtcctatatagggctctcacaccctgggtcactatccacctgccctaatcaccccaaggccaggtaccaggcaactagggacagcccctatgccccaaggctgcttaaattattcagactagccaatcctaaactggttactctcccttgcctgttccttcccacagaggcagagacaacaacaaatgctctggcttgcagttctcctgtctccctctggcccggaccaaccatggtgcttcgccatgagatttcccatgtctgggcatcctttcttctcttcggaactgtgactaacaatctgtctctccaaggcagtcatttcctgatctgtttcaaatgttctactaatccactctattttaaaacactctcagattcccctttaggatgttttcctcgctctgctgggagtgctgtccacagacagccttcagctaccagcttccttggagagcaccttggctccggagagcctccttgtttttccagtggcccacattcagtgactggtggaggcaggagtataaaatcagacatttttaatcaacgtaagaaaaccccaagggtcatttttagcttcagagtaccccatggagctggctgagggtaatgagacctcatagtagctcatttccttccttttccaaattctgtgttctgactgtgctctccacaggtactcatcccatatgtactctcacataaacatcctgcacaataaaatcagtcacacagactatctgttgcagtgcttcaagcatttgaaaaatatggtggagattgtaatggataaataagattctatggctactactaagctcaactgacactctagaagaagacaaagaaatcagagagaaattattatgcacttgaaagccgactgcgaaagccacagggcttccttgggattatacggagactttcaactcctggcacaggatggcagagaaagcttgtgatttaataatcatagaagtaaacctccaaagaaggttaaatttccacccaaagtaggaccgtttctccaggttcatggctcgcactgggcaaaattgagacccataatgtagtttggaatgagacctctagaaacctgaatttccacaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaagaaatcaagactgatgacaggtatactgaagagtttcgcagcccttccaacccctgccacaggaaactcgggatcctttgttcaattcctggacctgaatcaattttttacatctggaactttttgactgaaaaggaggttgggtacccaggcagagaaggtctgtgcagcaccacagcctgtggacacagtaatgattcacccagacctcccctcaagaggcatccatccgttgattcacgtcaccatgaactgtggaaaggaaaatgcccaggtatcttgagaaatgtcaagcatggagtaggagatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcttcctcttcctcttcctcttcttccttcttcttcttcttcttcttcttcttcttcttcttcttcttcttcttcttcttcttctttcttcttctatcccttcaagcatttattctttgagttgcaaacaatacaattgcattccttaagttattttaaaatatacggttaagttattattgactatagtcactgtgttgtgctatcaagtaataggtcttattcattgtttctggttaaccattaaccatctccaccacttccccaactccccactaccaatcccagcctctggaagccatccttctactttctgtgtccatgagttcaactgatttgatttttagatcccacaaataagtgagaacatcagatgtttgtctttctgtgcctggcttatttgccttgacatgacgatctccagttccctccatgctgttggaaatgacaggatctcattcttcttcatggctgaagagtactccattgggtatgtgcaccacattttctttatccattcatctgtcgatggacacttgggttgcttccagatcttagctgttgtaaacagttctgcagcaaacataggagtgtagatatatctttgacatactgatttcctttcctttgggtatatactcagcaatgggattgctggatcatatggtagctcaatttttagtttttggaggaacctccacacggttctccaaatggttgtactaatttacattcctaccaaaagtgtgggaactttcccttttctccacatccatgccagcatttgttactccctgtcttttggatataagccatcttaactggggtgagatgatatcgaatttttgacttgtgtttctcggatgatcaatgatgttgaacaccatttcatatgcctgtttgccatttgtgtgtcttcttttgagaaacgtccattcaaatcttttgcccatctttcgatcagattattagattttttcctatagagttgtttgaaatccttgtatatgctagttattaatctcttgtcagaggagtggtttgaaaatattttctcccattctgtgggttgtcacttcactttgttgattgtatcctttgctgtgaagaagctttttaacttgacgtgatcccgtttgtccatgtttgctttggtcgtctgtgcttgtggggtgttgctcaagaagtctttgcccagacctatgtcctggagatttttcccaatgttttcttgtagtagtttcagagtttgaggtcttacatttaagtctttaatctattttgatttgattttcgtatgtggggagagataggggtctagttgcatttttctgcatatgggtggtccaggttttccagcacgatttatcgaagagactgtcctttctccagtatatgttcttggcacctttgtcaaaaatgagatcactgtaggtgtatggatttctttctggactcccgattctgttccattgttccatgcatctgtttttatgccagtaccatgctgtcttggttactatggctctgtagtattatttgaagtcaggtaacgagattccttcaggtttgttcttgcttaggatagctttagctattctgggtcttttgtggttccatataaattttaggaatttttttttctatttctgtgaatagaaatagtatcaaaataggtattttgatagggattgcattgaacctgtagattgctttgggtattatggacattttaacaatattgattctttcaatccatgagcgtggaatatttttccattttttggtgtcctcttcaattttcttcatcagtgttttatagtcttcattatagagatccttcacttctttggcctagttaattcctaggtgcttaattttatgtgtggctattttaaatgggattactttttaaatttgtttttcaggtagttcactgttgccagatagaaatgctactgatttttgtatgttgattttgtaccatgcaactttactgaattagttgatcagttattagtagttttcttgtggagtcttttttttttttccaaatataagaccatatcatcagcaaacaaggataatttgacttcttcatttccaatttgaatgccctttatgtctttgtcttgtctgattgctctagctaggactcctagtactatgttgaacaacagtggtgacagtgggcatccttgtcgtattccagttcttcaaggaaaggctttcagtttttccacattcggtatgatactagctgtcagtctgttgcatatggcttttattatgttgaggtatgttccttctatacccaggttgttgagggtttttatcaggaagggatgttaaattttttatcaaatgctttttcagcatcaattgcaatgatcatatggcttttatccttcattctgttgatctgatgtaacaccttgattgatgtgtgtatgtagcaccatcctcgcaacccagggataaatcccacttggtcaagattaatgattgttctaatatattgttgaattgggcttgctagtatttggtggaggatttttgcatcaatatgcatcagagacaatggcctgaagttttctttttctttcattctttttgttttctgatgtttctttgtctggttttggtatcagggtaatactggcctggtaaaatgagtttggaagtactctgtcctcctctcctttttggaatagtttgagtaggattggtatcagttcttctttaagtgtttggtagcattcagcagtgaagccattgggtcccaggcttctctttactgggagagtttttcatatggctttgatctcgttacttgttattggtctgttcgggttttggattcaatcttggtaggatgtattgtatctaggaatttgtccatctcttctaggttttccaatttattgacatatagttgctcatagtagtagccactaatgatcctttgaatctctgcagtatcagttgtaatgtctcctttttcatttctgattttatttgcgtgtatcttctttcactttttcttagttagtctggctaaaggtttgtctcatttgtttaacttttcacaaaatcaactttctgtttcagtgattgttcagtgtattgttttcttcagttcaatttcatttatttctgctctcctctttattatttttcttctactaatattgggtttggtttgctctttcttttctagttctttaagaggcatcgttacattgtttatttgaaaattttcctcttttttgatgtaggcacttatagctatgaacttccctctgagtactgcttttgccatatcccagaggttttggtatgttgtgtttccattgccattcgtttcaatttccttcttaatttctgcattgacccactggtcattcaggagtatattgtttaatttccatgtatttgtacagtttccgaaattcctcttgctattgatttctagtcttattctattctatcgtggtcagagaagatgcgtgatattatttcagggttttggaatgttttacgacttgttttgtgacctaatgtatggtctgtccttgagaatgatccatgttctggggaaaagaatgtgttatctgcatctgctggatgaatcgttctgtacatatctgttagatccatttggtctacagtgaagattcagtctgaggtttctttgttgattttctgtctggaagatctgtccagtgctgaaagtggggtgttgaagtctccagctgttactgtgtcagggcccatctctctctttagctctagtaatatttccttcatgtatctgggtgctccagtgttgagtgcatatatatttaaaattgttacatcctcttggtgaatcgacccgtttatcattacatagtgacgttctttttcttttcttatagtttttgtcttgaaatctattttgtgtgatataagtatagcggctcctgctcttttttggtttccattggcatggggtatctttttccatccctttatttttagcctgtgtgtgctttataggtgaagtgtgtttcttctaggcaagagatcaatgagccttgtttcttcacccattcagccagtctgtgacttttgatgggagagtttttccaatttgcatccaatgttacggttgacatgtaaggacgtagtcctgccattttgttatttgttttctggttgttttgtgatcttctcttcattctttctttccttcttgtcttcctctagtgaaagtggttttctctggtgataagatttagtttcttgctttttattttttgtgtatccattgtatttttttttttttttttggtttgaggttaccatgaggctcaataatactatcttataacccattattttaacctgatagcaactgaacactatttgcacaaacaaacaaacataaagcaagcaagcaaaaagaaaactaatgaaaactctgtgccttaacttcatccccccacgttttaatattttgttgtttctatttctatatcattgcattgactatgtctcaaaaagttgttctagttattaatttttattggttcatcgtttagtctttctacttagggtaacacgagtttgtacaccacagttacagtgtcattgtattctgtgttcttctgtgtccttactattaccagtgacttttgtaccttcgggtgataatttattgctcattaacgtccttttctttctgattgaagtacacccctcagcatttcttgtaggataggtctggtattgatgaaatctctcagcttttatttgtctgggaaggtctttatttctccttcatgtttgaaggatatcttctagggtatatactattttagggtaaaagcgttttttgtttttttgtttgtttgttttccttcagcattttaaatatgtcataccaccctctcctggcctgtaaggtttccactgaaaagtctgctgccagacatttggagcgccattgtaaattacttgtttcttttctcttgctgctttcagcatcctttctttatccttgttctttgggagtttgaatattaaatgccttgaagtagtcttctttggattaaatctgcttggtgttctgtaaccttcttatacttggatattgatatctttctctaagtttgggaagttctctgtaattatctctttgaataaactttatactcctatctcttcatctccctcctctttaagcctaataactcttagatttcccccttcgaggctgttttctaggtcctgtaggcatgcttcatttttgtgtattttttcttttgtctcctctgactgtgtattttcaaatagcctgtctgcaggctcactaattctttctttctgcttgatcagttctgctatcgaaggactctgatacattcttcagtatgccagttgcatttttcagctccagaatttctgcttgattctttcagattatttcagtctctttgttaaatgcatctgatagaattctgaattcctactctgcattatcctgaatttctttgagtttcctcaacaaagttgttttgaattccctgtctgaaaggtcacatacctctctgtctccaagattggttcctggtaccttatttagcttatttggtgaggtcgtgttttcctggatggtgctgatgcgaatatttttttcttcagtttctgagtatgtgaactgttaggtattaattgtagtcttcactgtctgggcttatttgtagccgtccttcgtcagaaggcttttcaaatatttcagaggacctgggtgtttggatctaagctgtgtctgcttcagggggcaccccaagctcagtaacgctgtggttcttgtagactcatagagggcaccaccttgatggtcttggacgaggtccgggagaattctctggattaccaggcagagactcttgttccctttccttactttctcccaaacatacagagtctctctctctctctctgtctctgttctgagccacctaaagctgagggtggaatgacacaagcacccctgcagccaccactatgcggccaccactactatgactgcactgggtcagacctgaagccagcacagcactgggtctcccccaaggcctgctgtaattactccttggctactgcctttgtttgctcaaggccctggggctctacaataagcaagtggcaaagccagctaggactgtttttcccttcattggagagaggtcccccaagccccaggtgggtccagaagtgccatctgggaatcagggactagcatcaaaaaccttagaaggctacctgtggttctaagtattgtggctgagctgtcactcaaaccacaggacgcagtctttcccactcttccctccccttcccaaaggtacaagagcctcacactgtagccaccgccaccctaggccccgagcagtactggcagactactgccaatgttcccttaaggctcaaggtctcgtaagtcagctgtcgtgaatgctgcctggcctgggactcacccttcggggcagtgggctcccctgtggctcagggcaggtccagaaatgcagtccaagagtccagtcctggaactggggactccaagggtctgcttgatgctctaccccactatggccatactggtacctaagatgcaaaacgaagtcccctttacttttccctctgcttttctcaaactgaaggagttttgccccatagccaccacttgctggttatgtaccaagtctcacctgaagccaacaagtctcagaggttcacccaaggccctcgatgtagtgcctgggcatcactgctggttattcagggcccaggggctcttcagtttgcaggtggtgagtgctgccaggactaggtcctttccttcaaggcagtgggttcccttctggcccaggacgtgtctaggaatgtcctctagtagctaggtcctggaacaggggccacgtgactctgactggtgccctatcttgctatggctgggctggtatcccagatgcaagacacagtcttcaccactgttttctttctcccctcctcaagtggaaggaaggggtctccttcggagccacaaggtgtgcagcctggggttaggggacgggtgatgccagcactcccttggctgccccagctggtatctcagtatgtcgtgtgaccccccccctcccccgacccctggtccactgtctctgggcctaattcaacaccaggactcacctaagagttgcagttcttttttttgtttgtttttttgagatggagtctcgctctgttgcccaggctggagtgcagtggcacgatctcagctcactgtaagctccgcctcccgggttcacgccattctcctgcctcagcctcctgagtagctgggactacaggtgcccgccaccacgcccggctaatttttttttttttttgtatttttagtagagacggggttccaccgtgttagccaggatggtctcgatctcctgacctcgtgatcctcccgcctcagcctcccagagtgctgggattacagccgtgagccaccacgcccggccagagttgcagttcttatggcctagtctgcctttcaaatttacttggagacacagagtgctgtagcctgccatggtgaggtttgtgggaactcaagttctgatcactgggatcagtgattcccctctggctagggctgctttaaatgctccctctgttgggggggcatgagctgagtttggtccggttttcctttctgctctaacaggatagcactgaggtcattgcttcacaaatgctgtggtctccctccccctgcacccagagatgctctccacaccatgctgctgtggccaggggtgggggaggggtggcgtcggtaattcaggactatgttttggttctcagggagaatgcttccaggttttggcctttgagtaggatgttggctgtgggtttgtcctagatgactcttattattttgaggtatgcttctctgatgcccagtttgttgagggtttttgacatgaagggatgttgaatttcgttgaaaacctcttctgcatctattgagatgatatgtggttttcgtttttagttgcgtttatgtgatgaatcacatttattgatttgcacatgttgaaccaaccttgcatcccaggagtagggcctacttgatcgtgatggattagttttttgatgtactgctggaatcaatttgctggtattttggtgaggatttttgcatctaggttcatcaggaatattggcctgaagtgttgtattttcactgtgtctccgtcaggtttgggaatcagaatgatgctggcctcgtacaatgagttagagaggagtcccagttcctcaaatttttggaatagtttcattagggattggttacagctcttctttctgtgtctgatagaattggactgtgaatccgtctggtccaggcctttggttggtaggtcttttttattactgattcaagtttgaaactcgttattggtctgtccagggattcagtttcatcctggttcaatcttgggaggttgtatgctcccaggaatttatcgatttcctctgggttttctagattatgtgcatacaggtgttcataatagtcgctgaggatttttgttgttgttgctgcatttctgtggggtccgcagtaatgtcacctttgtcatttctgatggtgtttatttgggccttctctctctttctttcttttccttgtttgtctagctagcagtttgtcgagcttatttattttttcaaaggacctttggttcctttggtttctttgaccttttgtagggtggttcacatctcaacttctttcagttcagctctaatatttgttatttcttttcttctgctagctctggggtcactttgctcttgtttctctagttcctctaggtgcgatgttagattgctaatgtgagatctgtctgactttttccatgtaggcacttagcaccataaactttcctcttaacactgttttagctgtgcccccagagattctggtatgttgtacctttgttttcaatagcttcaaagaatttttttgaattctgcccaaattttgctctttactcaaaagtcattcaggagcaggttgtttaatttccatacaattgtttggttttgagacatcttcttggtattaatctctattttcattgcactgtggtccgagagtgtggctggtaatgatttcaggtttgtttttgaattttttgagaattgctttacggccaaacatgtagtcgaccttataatataattgattggttttgaaagatctatatataattgtttgcctctgagagatcttcctgctacagatgtctatttttattgcactgcggtctgagagtgtggctggtatgattccgggtttgtttctgaattttttgagaattgctttatggctgagcatgtggtcgaccttagagtatgtgccctgtgcagatgagaagaatgtatattgtgttgttgtttcgtgcgatgttctgtggatatctgttaggtcaattctgtcaagtgttgagtttatgtcccgaatatctttgttagttttctgccccagtgatctagcactgtcagtggggtgttgaagcctcccactatgattgtgtggttatttaagtttctttgtaggtctctaagtgattgttttgtgaatctgcgtgctccagtgttgggtgcatatatattaaggatagttaagtcttcttgttgaattgaaccctttatcattatgcagtgcccttctttgtcctttctgatcattgtgggtttaaagtctgtttcgtctgaaataagaacagcaacctctgctcttttctgttttccatttgcttgatagatctttctccatccctttactttgagcctatgatgggtgtcattgcatgtgagatgggtctcttaaagacggcatgcagttgggtcttgcttctttatccaacttgccactctctgccttttaagtgggggcgtttagcccatttacattcaaggttaatattgatatgtgaggatttgatcctgtcactgtgccgttagctggttgttatgtagacgtgattatatagttgcttggtagtgtcagtgggctgtgtacttaagtgtgtttctgtggtgacaggcaacgaccttttgtttccatgtttagcgctcccttaaggacctctggtaatgcagatctgggggcaatgagttcccttagcatttgcttgtctgaaaaggattttatttctgcttttcttatgaagcctagtttggttagatatgaaattcccagttggaatttcttttctttaaggatgctgactattggctcccaatctcttctgacttgtaagagttctgctgaaaggtttgctgttagcctgatggggttccctttgtatgtgacctgccccttctctctggctgcttttagtggttttcctttcaccttgaccttggagaatcttatgactatgcatcttggggatggtcatcttctgtagcatctcactggggttatctgactctcctgaatttgcctctctacctgtctagcgaggttggggaaatgtctgtgggcaatatcctcaaatatgttttccaagttgcttgctctctccctctctttgtgggacaccaatgagtcataggtttggtctcttcacataatctcatatttcttggaggttttgttcatttttgttaattctttttttccttgttttagtctgattgatctgattcaaacaactggacatcaggatctgagattatttcctcaggttgttctagcctgctgttaatacttctgattgtattatgaaattcttgtagtgagttttttagctcaagcaggtcagtttggttctttcttaaaatggccatttaatctttcacctcttgtattgttttattggattccttatattccttggctgccatgtcaactttctcgtgaatctcaatgatctttgttgccatccagattctaaattttatgtctatcatttcagccacataggtctggttaagaaccattactgcagagctagtgtggccatttggagacaagaagacactctggcttttagcattaacagagttcttgggctggttcttcctcatctgtgtgggctgacgttcctttaatgtttgaggttgctgtcctgtggatgggcctttttgcttttacattctttgatgaacttgaggttttgatgtggtataagtcaatttagtcaattggcttcatttctggatgattttggggaaccaagacacagctcagcgctcctgggctgcatgctctacccctgggggctgggacgtgtccatggttttttttgtttgtttgtttttgtttttttttttttttctggactctgaaggtttactgcctgctcttctggaggggctgaggtgttcccattccgctggcaacagcactctgatgggatgttccggccaaagtacttccgtggggcagcggtagggcagcaagggcccccaaatgcatgggctcaccagcgaagcagtgcaggaaggctatgagtgagagtgcatcggtggaggagggctgcgggagggtgcacttgtctgcaggggaccacctgcagaagatccccaactgctaggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtggtgaggcttggggttgggtgcccatggccatgcttcagtgcagcttttcccatgctaaaccctctggactccatgcaggcaagatttctatctctgccagctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcagggtctgtgtccttcctccatccattttcaatgccttctttccaaagatctgtttggaatgtgctggtcttcttgatgatcgggtctcttattgggaggagttcttcctgtctgcatctggtcagccatctttgccccaaagccttcagtaatttttaaatctgagaatgtgttaattttccccttcatttttgaaggatggttttgctggatatgtaattcctgcttgacaggtttctccttttttagaactttgaatatatcgcctactgcttgaggactacatatctcttatgagatacagtctccttactagttatagtaaggagttatcagtaataggaattatcagtaatcaaaaccttccaacaaagtcaagtcttgggccagatgacttcattggtgaattctaccaaacatttaaagaagaattaccaccattccttctaaatctcttccaaaaaattgaagaagagggaacacttcctaactcattccataaggccagtgttagttaccatgataccaaagtctgccaaagccacaacaagaaagctacaaagcaatatcccttatgaataccaatgttcagaatcctagatgaaacgctagcaggcagaaccttgcagtatattgaaaggattacacacccatgactgaatgggaataattgctgaaatgcaaagatgattcaacacatgaaaataaacccatgcactatattaacagactgatgataaaagaccgcatcaccatgtcaactgatgcagaaaaagcacctaacaaaatccaacatggttttataataaaaaccctcaacagattaggaagagaaggatacttccttagcgtgacataaaccatatatggaaatacctatagctaacgtcatactcaatggaaaagactgaaaggttttcccctaagatcgggaacaggacaaggatgcctgcttttgtcacttctaactcaacatactattgaaagctctagacagagtaattaggcaagagtaagaaatagaaggcatctaagatggaaaagaagaagttatcccctgtcacagacgacatgatcttctatgtagaaaaccctagagattccacaaaaaaagctgttagggctaataaatgaatttgtcaaagttgcaagatagaaaatcaacacaccataaccagttgcatttgtgtacactgacaatcaacagtccaagaataattaagaaaataattacatttacaatagcacgaaaagaatagaatactcaggagtagacgtaatcaagacatttaccttgagaactacaacactgcttgaagaaattaaagaagacataaataagtggaaagatgtcctgtgttcatgggttgtggttaattttgcgaaaaagtctttcctgctctgaggacataaacttaggcactctcgtaattgttctaacattttttaaaatttcaatagtttgggggcatacaggtggattttgattacgtggataagttcttcagtggtgattcctgagattttggtgcacccgtaacctgagcagtgtacactgtacccaatagatagtcttcttttatccctcaccctctttccacctttccctccgagtcccctaagtccatcatgtcattcctatgcctttgcaccctcataggttagctcccacttataagtgagcgcatacgatattaggatttccattcctgagttacttcacttacagtagtggctttcagctccatccaagttgctgcagaggccattatttcgttccactttatggctgagtagtattctgtggtgtatatatgccacatcttctttatccactcgttgattgatgggcaataaggttgcttccatatttttgcaattgtgaaatatgctgctataaacatgcatgtgcttgagtctttttgatataatgacttgtcttcttttgggtagatacccggtagggggattgctggatcgaatggtagttttacttttagttctctaaggaatctccataccgtttcccagaatggttgtactagtttgcattcccaccagcagtgtaaaagtgttcccttttcaccacatccactccaacatctattattttttgactttttaattatggccattcttgccggagtaaggtggtatctcattgtggttttaatgagcatgtccctgataattagtgacggtgagcattttttttcatatgtttgttggctggttgtatatctttcttttcttttttttttttttttttgagaattgtctattcatgtcctttgcccacttttggatgggattttgcttttttcttgccgatttttattgagtttcttgtagattctggatattagtcctttgttggatgcagggtttgtgaatgttttctcccactctgtgggttgtctgtttactcttctgagtatttcctttgccgtgcagaagctttttagtttaattaggtcccacttgcttatttttgtttttggtgcatttgcttttgagttcgtaggaacgagttcttgtaaatttgtttgagttcattgtagattctggatattagccctttgtcagatgagtagattgcaaaaatttcctcccattctgtaggttgcctgttcactctgacggtagtttcttttgctgtgcagaagctctttagtttaattagatcccatttgtcaattttggcttttgttgccattgcttttggtgttttagacatgaagtccttgccgatgcctatgtcctgaatggcattgcctaggttttcttctagggtttttatagttttaggtctaacatttaagtcttcaatccatcttgaattaatttttgtataaggtgtaaggaaggaatccagtttcagctttctacatatggctagccagttttcccagcaccatttccaaaatagggaatcctttccccatttcttgtttttgtcaggtttgtgagagatcagatagttgtagatatgtggcattatttctgagggctctgttgtgttccgttggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttacagtagttttttccaattctgtgaagaaagtcattggtagctcgatggggatggcgttgaatctataaattaccttgggcagtatggccaaaacaaccccatcaacaagtgggcgaaagatatgaacagacacttctcaaaagaagacatttatgcagccaaaagacacatgaaaaaatgctcatcactggccatcagagaaatgcaaatcaaaaccacaatgagataccatctcacaccagttagaatggtgatcattaaaaagtcaggaataacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacgtggaaccaacccaaacgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcgctcataggtgggaattgaacaatgagaacacatggacacaggaaggggaacatcacacaccggggcctgttgtggggtggggggacgggggagggatagcattaggagatatacctaatgttaaatgacgagttaaggggtgcagcacaccaacatggcacatgtatacatatgtaacgaacctgcacgttgtgcacatgtaccctgaaacttaaagtataaaaaaaaaaggaatgaattcattacctaagccaatgtctgcaagagtttttcgatggtatcttctagaatttttgtggtttcaggtcttagatttaagtctttgatctatcttgagagttgatttttgtaataaggtgagagatgaggatccagtttcattcttctgcatgtggcttgccagttttaccagcaccgtttattgaatagggtgccctttcctcgctttatgtttttgtatgctttgtcaaagatcggttggctgtcagtatttggcttcatttctgagttctttattctgctccattggtctacatacctgtttttatgccagtaccatgctgctttggtaactatagccttgtggtataatttgaagccaggtaatgtgatgcctcctgatttgttctttttgcttagtattgtgttgattatgcgggctctcttttggttccacgtgaatttgaggatatattttttttctagttctgtgaagaatgatcatggtactttgattggaattgcattgaatttgtagatcgctttgggcagtatggtcattttcaccatattgattccacccatccatgagcatgggatgtgcttccatttgtttttgtcattgatgatttctttcagcagtgttttgttgtttttcatttagagacctttcacctccttctttttccactaaggtttcttttttttttttttaatttctggaatttatattgtgtatggagtgagatagcaatctcctctctaaaaaatgggtataaccaatggatccagcactatatattgaatagcctgtcttttcttcagctaaccttcaatggcaaacctctcatgccacgttttcctatatttaatgggctctctatcctatcaattgtattggcctagatgtcatataagtgaactatcttaactatcttaattattaaaacttgatatcttgtaagccatgtcccttctgatcccctctactttgttttaatattcttggatattaagcgcccttggtccttcagtatgcattctagagtcatagagtctattgttccgtagaaagctgtgttggattttttattggaatcacgtcaaatatacaggttaagtggagaaaaccgtcatctttatcatagggattcttccatgagcatgctttatatctgcctaatttggaactaatagctctcgataacatttgataattttctcatttaaagtctgaagcatctttgttagacttatttccatgtaccttactattttgtggcagttataattggtgttcattgaagagttgtttttcctctaagtggttgttgctggtttgtaggaatacagttgattttcttcttagctgtaattaatgctgagagtttgtagattatctcaggtttttccatacaggtaaataatatattgtctatatagatatgatcgtttgggtgtttttaattccaatcattatatcttttatttattgcactggctagaaccgccactgttgagcagaaatgacaatattgagcaaacttgtcctgttcttgatttttaaggacaatccatgtaaatcttcaccagtgtgcacagctgttggtgcagattattttgtagatatgtgttttccatctgttttttcccagtttggcaagaattgtgttttggtttgtttttgtgtgttccgtgaacaggcactggattttatcaaatgattttaccctgtccattaaaatgatagcccaatcttgtttctttccattaatgggatgatttacattaacattcctttctaatgttaaggcatttttacactgctgtgatacaccaaacttgttctggtttattatcatttctgtgcgtcacttaagtctgcagtatttaatttagcatttagcttgaattataaatttcctttctcctattatacttacctcattttagagtcaagattatcctcataaaatatacttgggagtgtaagcttttatcttggtctttggtgaagtttgtatgaacttggaattaattatctactccttgaatgtttagtggaattttccccgtgttcctggtagttttcttgacgttgttttttttttttttgaactaaagatctattttttttaatgtcaacttttatttttagatagaatggttacacatacaggtttgttacatgggaatattgtgtgatgctgaggtttggggtgtggatcccatcacccaggttttgagcatagtatccaataaataggttttcaacccatatcccctccctgccccctcgagtagtccacagtaatttctttaatcgttgttaagtctagtcaagttttctatttcttctatagttagtttaggcaggatatgtttctctttcaaaatttctacgttgtctaggcattaatttatatcagtatgaaattgtttttggtattatcttgtttattgtttatgtctaatcatattctgcttgttaatttttaatattgttcctttgtgttctctctctctctcctcctgtccactgctcttcatctttctcccttcaccagtattgccaacgttggctgtttcgtcagtcttttcagaaaccaacttttggtttggttgattttgttgattctctctattgtacttttctttctctctttctttccatatatatatatatatatatatatatatatatatatatatatatatttagttttgtttgttttttttgttttgttttgttttttgagacagagtctcactctgtcacccaggctagagtgcagtggcgccatcttggctcactacaacctccgcctccctggttcaagcgattctcctgcctcagcttcctgagtagctgggattacctgcgcgtgacaccacgcctggctaatttttgtatttttagtagagacggagtttcaccacgttggtcaggctggtctcgaactcctgaccccgtgatccgcccgcctcagcctcccaaagtgctgagattaccatgcccggcctctattgtacttttcttttatacctcattgctttctcgcctcatattattttttctttttatttttctgcttttcttttgctcttctttcaagcatggatatgactctacacagctgcacccaggggtgacctttaaagacagtgcagagaaaagtatctccctgttgtggggtggggggacgggggagggatagcattaggagatatacctaatgttaaatgacgagttaatgggtgcagcacaccaacatggcacatgtatacatatgtaacaaacctgcacgttgtgcacatgtaccctaaaacttaaaggattaaaaaaaaaaaaaaagaagtctgttgaaaagatacactatggaccttgggctcaaagacctacggtaggaagctctgagtaggatgtgagaaaaatcaatgtgacagtgaaaaacaattattatgtacaactcttttatattctaaagaagggggttaagaataaagatccttgatgtgctgatcagggtgatgagtctgaggattcagtcatcagaatctcacagagataaatggctccacagagaaaagagatttgaagggaatgagactgttcaggaagaacaggagctgatgcccatccatctcatgagggtatgaggaagagaggcaagatagtctaacgcagactgtttggtgacatttcactgggacacgtgccattgaatctcccccgtttgtccccatgaagacgtctacaaatgcgcattgaatgttttggtaatcagatttatcattggtttgggggtggggggtgaatttcagcatctactgtcaagcggggcaagagcaaaggtagctcttggcgccctaatagtactctgcttcaataagttagctgtggtcattgcaaattatgtcagcagaagttgagtggttaaacatgggctttaccttcagagaaacggaacaattctgaaaaagaagaaaagagagaagatccaaacttgccacaggcacatgcagcaggttctccagtcctctttagagtggtttagctgtttaaaaacattgggtgggttctggcacgtgcctagtgttttccactcttaccctgtttatgcacctctgtcctgcttccttgatcagctgcccaccagtcctgagattctcccaacatggatcacttctcagtcattgagaagggaatatgagaggaggtctagatcattatgttcttatttggcagtttaattgttaaaaggaacattcaccaatatactcccacctcgacacccacagaacgtaaaaataaactgttgtaggatgtggtacagtggctcttacagggtatactagagaagaatgaggatgtgaagaaaactggggttcacattgagcctggggtggaaatcctggctgttcagggtggtggaaagtgtagggctgattgccattcctatgatgccttccttgaatcctccggtaagtatccacatcttctagtctctgacttcgaccatatttatcacctctaataccagagttctgaagtttgtttcttgctggattagtttctgtggtcttctaaggacttatgacctatacgtctgttttatagcctataaaattttgctaacatatttttcttggtgtggtgtcgttgtctggtaccttctgattttttgtcccgctttgcaccccccgcccccccccacttcattattaggggttttctggtgggagcataaaaagcatttgcactcagtattcctgaagtaatcagaagtaaattgatagattctctaatgttccactaccctttcattcctggaacgaacgcttttttaatagacatatactagttaagtttagtaataattaatttagaagttttgcatctgtaattatatatactataatttttactgctcgtactgtcctttttgaactttcagtgtctaattttaccagcctcatgatagagactttaaaaataatctcattgactttactgacaaatgtcttattatgtctgaaatataatggatctagaacctgaaaaaattagttaatgaaatgcactgaaatgaatggaaagtaggatactcttctatggtttttaaaaattgaggcatttactgagtcatatagtggcccccgccaaattcctgtccaccctgaacctgtaaatgtggcagtatttggaaatagtgttttttcagacgcagtcacattaagatgagatcatattgaaccaggcagggtaggccctaactccaatatgactgctgtccctataaatagaggtagatttggacaaggagacacagacacataggggagtcgcgtggagacagagacagagactggagtaaggcattacaaaccaaggagtgacaaggagtaccagcatccaccaggaactaggagagctaagaaaggcttcttccgtcagatggagcatggccctgctgacatcttgattttgtacttctagcccccagaactgtgtgagaataaatttatcttgcttttagccacccagtttgggtattttgttatggcagccctaagaaactaatgcagattttagtgctaagacgtgggttgttcctgtcacaaatgcctaaaaatatggaagtggctttgtaattgggtaatgactagaggctggaagacttgaggcacatgatatgaaaaccctagattgccttgaagagaccgttggtagaaatatgaatgctaaaggtgattcttgtgagagctccagaaggaagtgagaagagttgtagaggaagtgcttatcatcttagagaacacgtgtatcattatgaacagaatgatgctagaaatatgaatattcaagctgcttatgatgccgtctgagatggaaattagacacatgttaatgagcactggaggaaaggtgacccttgtgatagagtgtcagaaaacttgaatgaattgtgtagaaagcaggtcttgtaagcgacgaacttggatatttagctaggagatttccatgcaaactctggaaggtgtggccttgtctctttatagtaaaacgtgagagtaaagagataagttgaggaaggaactgttaagccaaaaggaagcacgcttgatgatttggaaaattcacagtctacccagatagtgcactatggaaacagggccaaaagtgtggctgaacagccatttgctaatgagactagctaggcatgtggacccaaccaaccaccttggccctaagccaggaaaccagataggttaatccaggaaggacccacacagagcctacatatctagttgtgtggatccccttggcatctgcaaaaacatggcaaggattttgagagttttatactagcagaaacgctgccagcctggactgaaatgtccagagatgggacaaaaatgaaagaagaatgtctctgaaggcagaaacatggaagaccagaccagaaatggcattgtcattaccctggagggctggatggactgagtccctgacccagaaagccaggaagatggggctgcctccctggagggtcctaaagtttggggctgcctccctgaagggcccttgggacagaagattgagccatggaagttcactctcggcctgaaacttaatggacttttttcctgctgggttgtgaacctgccccagagcgacaacccctttaatctttccaccttctcccttttgtgaaggggacgtctaacctacgtccgtcccactgtagtattctggaagtagataacttgttttctagcttcatgggtctgcagacagagaggaacattgccccagggtggaccttgcccaaagtctactcggtaagatcctgacaattttagatgagattttggatttagggttaatgctggaataggtgaagatctggaggatttggagatggggtgaatataatttactcacggtaagaatgtaaatattggggagccagagggcagactctattgggttgaatagtgcgtgcacccccctccccaaatttatgtctacctggaatctgtgaaggtgattttaattggaagcaaggtctctgtagatgtaatcaagtgacgataaagtcacactggactagggtgtgccctaatccaatgactggtatctttataagaagaggaaaattgggacaaagagacagacacacagggagaataccatgtgacaaccgaggcagagattagggttaagctgccacaagccaaggaatgccaaggattgccagcaaccaccagaagctaagagagatgtgtggtacagattctctctttaactgccaccctcaccacaaggtaccaatcttgctgacaccttgatttcaaacgtttggccaatagaaatgtgagagtttaaaattctgttgtttcaagccacccgtttatggaaatttgttatagcagcctgaagaaacgaatacagcacttgagtcctgtttagcaaggatcaagctagagctctttggtcactgtgtctagcctggtgaacatcagtggctgcttggggcagccatatggacattatttgtgattgtgcatccctgagatgggcctggggatgagcccttgtgagttatgcaaaaaaaaaaaaaaaaaaaaaaaggaaggaccccagcaccccagggagacttaagcatggcaccaagttgcctaacagtcattgtttttcaggcatgggtaccacagttgctgccgtagcatgcattctccttaccctcaagcgtattcatgtgcatagccatggcagccggtgtcccagggactgatgattaaataaagagggtggtggaggaggagcgtttggcactcagctgctcccacagtgctaaaccacttagcccttattctatgcagagctatatctaagtttcatttaattctcacgccaaattgaggatcatgatggaaaattttgtctatagctaaatagaaagctgaaactaagaaaggtcaagtatcatgaagtaaaagagaggttctattagtaatagcaaaaacttggacttcaagcactgtgttcctttcatttgtttttaaattttatttattttttaattagacaaaattgtatatatttacggggtacaatgtggtattttgataagtgtatacatttagaaagactaactcaagctaattaatatatccatcatctcacctacttatcacattttgtgttaagaatatctaaaatctacttttaaagcaatattgaaatatatgatacgttgttattaactctgctcactatgctgtgcaattgatcaccaaaacatattcctcctgtctaactgtgctccagtcccaaatcctcagcagtaaaatgcccctgtctctcctcagtgaaaccactcttgattaataaagtagtcttagtgtagtcttacctggggcttagttgtcccagatctttcctgccatccaccagaacctctttgcctgtagagagtcttctgaacttgagaagctgcaggattatgaaagcccagcatgtcatacacttgcctgctcattgctccttctctcaccttggctctcttgtctctcatagcaatgtcatctcaatatcgggcatcatgaacataactcttccggcctgtcacagaaatgaagcaaataaactgatggaaaaaaaaccataaagaaacccacaataccagccacaagtcaaaccatttaaaactgttacttttgtattagtatcagacaaaatagacgttaagacaacaataattatttggaataaagaaggccaccatgtagtcatgatagaacatttatcaaagagctaaaaagtctgaacttaacatgcactcaaaaacatagccaagaaatacataaagcacgatgttcagagttacaagaaggttgccacaataaaatataaaagtgcactattttagagttggggcagttccaagaagtagcaagatccagggagtgcccctgagcatggcagtcaaataagaggtcttgcgaccatgaggcttggaatcagactggttttctacatggacattgaaatcacccaggactgtgacaagattaggtgtagaaactctgaatgagacataaaaatctttgaccaaaagaccaatacgttggttttattttagaaagccatctttgtaagatgcccaggatggccataaaattgaatgtgtattggtcagggatatttaaactacaactaacagaaagtgcaagtctcgctggcttatccaataggtaaagacacttgcttatataactgagagttcagaggcagagtgagtttcatggttaactgagccagtaacggaaagatgtaaacatccaggctaaatcttgacccaaccactgctggattgggcattggattattggattagattagactaattctgggcccactcttggagctaagaaagtggccatatatcctcaagcacatgactctactgggaggagatacactgatggaggcctgagcccagccaggaaggtgaggaatgtatattgtgtaggtaaacaaaaatgtcacctgcaggtacagactcaaattatatataccgctatgagcatagtaaccacaatattcaagtccttcttgtgtcctaatagagtgactcttcgggtaacaaagacggatattttattcaggagctacctatattgaattcatgaataggcggttacaaagcatgagagctctcccctgtgcagtatatgttttggaagaacctcaacaggcatccactgtgggatgcttaaatcccattttcattctttttcgattcgtcggcaaagttttctattcgctcttgtcctgagatgatgttgtgttaggattatttgaccagaggtaactgaattcttcgtatttaccgttaagttttgtctttctgtaaacacgcgacacagacttcacaaagatatcaaagatcctcagatttcagtatggaacaaccttaaaagccctgggtctttagaagaaagtcagactcagccaggcgcggtggctcacgcctgtaatcccaacactttgggaggccaaggcgggctgatcacgaggtcaggagatcgagaccatcctggctaacgtggtgaaaccctatctctactaaaaatacaaaaaaattagggcttggtggcacgcgcttgtagtcccagctactcaggaggctgaggcaggagaatcacttgaacccgggaggcggaggttgcagtgagccaagatcgcaccactgcactccagcctgggcaacagagcgagagtccgtctcaaggagagaaaaaagaagagagtcagactcctataatgtaccaaaattaaagaacaaccttttcctctaatgcacacatttattcacgctttgaaaagaatatgtttccataacaataccaaatatgcatatgaaaagaaaattaaaaataagataatcacccaatctgcgaatatgcagatttgaaaattaattatcaatatataaatggaagctcttaataaagacgttgtagtatcacatagacaagatatgtaatgtgttattgctcatgttttgccttagtctgcatctacactgtgaaatgagcttaatcgtgttcactggttcattatttgctaactccttgattgacttagccagttgagcaatccagccagtgagtcattctataactgttgataaactacgtgatgttttaaatccaaggattaaaagaaaacacaaacattatatatcttgccttttttcacaggatctaatcactgataataaattatcagtgataagctgatcacaagaaacaaggtataaatgctgcatacactaaaaagaaaacaatgtggctgactatgttttaaaaattatctgacagtattttccaacagagtatttagaactatttcttgaattgcaaaatatagttgccttgagcagataacaggaagcaatctgggaaatttaaaattctctacttttaatacattagaaatctttgaatcataattgctcattgttttaaatggtcttcacagtggagggggtttggaccagagagctgcatcttcacaaatggcactgctcttcagtaaacaccctctatggaatccctaccttttcactcctctccatcctttgcctgaaggaagttttccttgtagacataattttgtatttgtatgttgtggtagtcctcaaagagtgagcctattacctagagctgttgaattttaccttgcattgaggggttggcatattgagcaatttgccagggagcactatctgcaactgcttctctttttttcctattgcttggcactgacataaagttacttctagctacgctaatgaatttcacgaaggaacacagaaaaacaggtcttgaatgtaatgcccgtaatgatagagtcccatcttatgctttcccttgtatgctgttgctaggtcagtcatttttactttctgaaagttaatttacataggacacctagttcaggtgtatgtatctgttcaaaccaaaagcgttagagtatttatgtttaatttaacaacgtcgcaaccgttctgatacttaggggagttctgagtaagtaagttctagaaaggggagttccagtactcccctttctctcttttctgtgttaggtaaagccacccctcctaaagccactagcatggatccccaaaatgtccaccacagaacgaaaaggtaaaagaaggagaagttgttcctgttaaatcctgccgtatcacacgcaagagaaatggcttatcaacctgcctcaccccagtaaacacagcgcctaataaattcagtgcctaaactggaccccggacatatgaatctttgtccacagagttaccttcccccactgtttgtgcatattagagcaccgacagacttccattggtgtaacttaaaaaaaaaaaaatcctaacaaagtcctgataatcatctcagagaaagagtgaatgatatgagtatcaggtctgacaggagcaaactgtgaattaaagtaagagttataattaggatttgtcttttggtgaaagaatttgaccatcatcaataccgtgtaagttccagttgagcataggtgggctagataaaattgtgctgtgccttttactggtgatctgttcatctgtatgtaatgatagaaacgggggccagggcagataccaggtcttgaagtaggcttccatcctgtgactttgtatagatacttcctaaatccaacttgaaatttcataataggctctttcataaatatgtagccccattttatatcctctatttacatgtgtcccataaataattctccagaattatccgagacccactgattggcgcttcctagtcattcattccaattatcatgacttcagtctacggccataccaccgtgaacgcgcccaatatcgtccaaatatcatgacttcctttgataaccttagagccactaacacagcctgttgtcctcactagtatattcaactttaactgtggtggaaaatttggtctgttgagttttcttctgcttatttatgtagccaggccacagtgcgggaacctagcaaagtaatcccaatgcttgtatagcattgtttgcctctgcaagcaaatcagaaagactccactccaccaaatttattttggacatgcaggtgaagctgcagtttcccacacaaaccagcaaaacaggtggtcgtgaaattgcgattaacaacaactgcaatgtgtactctccttctcttttctctatcctttctggggagacacaggcagaataaaaatacagtgaaatctaattataattcagattccactcatacaaaattgttgcagttcaggccagagccaggtatgatgttttaaaagtgctaatctttctcttttcagtaatttttttaaagaaggaaatgttttcagctaacctcaaacattttatactgactttcatatatacatattttatatattaatggtaggtttatatgtatacatttaaatgaatctcctgaggtccttaattagattcagcattgactggtgctaattactgacagtacttgaaatttcttagttggtatttcaaagagaacatccaagacctcaactcttcagtaactgggtctggcttccagtttgtgtgaattaataaggctgaactaaaattaatttcctttggaaaacccgggggtggtcagaacagtctagcaccatactgcctgggggagacagctggtttgccacctgcaatgtctgtgacctcttaggcaagtgatttaacgcctctgtgcttcagtttcctcgtctgtaaaattctgttatactacctactccatagagttagcactcttaaatgcggtaaccttttggagtgtgtggcacatactaatcactatacacatttttctttttcaaatgaacaactaaaattcattaggtttgccctaatttcctttggccctgtatgaaattaagtaaacagtgcttacctgtacggactgcttaggctcttgcagtagtgtctatgattatggttttagtgaggaccttcttcattgtgaagtattaaatttcacgtgttgttagaaatgaaacacataaaatatattaaagagggatggggggccgggagcggtggctcatgctgtaatcccagcactttgggaggccaaggcgggcagatcacctgaggtcaggagttcgagaccagcctggccaacatggtgaaaccccgtctctactaaaaaaatacaaaaattagctgggcgtggtggtgggcgcctgcaatcccagctacttgggaggctgaggcaggagaatcgcttgaaccgggaggcggaggttgcagtgagctgaaatcatgccattgcactccagcctgggcaacaagagcaaaactccgtctcaaaaaaaaaaaaaaaaaaaaaaagtgaggtgagggtagcaaaagctcaagtctgtgtgctgtgggaggttatctggaggtaccaccatctcagtaatatgggcaatctcagagctccaggtctcatgaacagaacggtctcctgaaacatgcagatcaggagaactctgcagtggttggattctactgtcaggaagttgacccaagctcacccacctatcctgggtacttgagccttgcaggatcctaaggctgcaagccacgtggatgccaccatcatgtgaacactacaattatgagccctactgatagggccctactggtcatatcagcaccaagggctctaaaactttgaggtcatgtggcctctcttgtcatgttgctcctatggtcatgtgatgggcccagctcttccagtcactacagtatggtggactcctgaaccctgttgctcacatggattcttccctcacctggccattactggctaccagcatgtggaagtctcagccctcgaagtcatatagatgacctactgtttagggtcatgtggatgctatggtcatgtccactgctcccactcacccctccccatggccacagtgtcaggctcattcctctctgtcacgtgaagattgtgagctgccaaactctgcagatgtgtgtgtgggcagccaagtggctcctgtcatctcgtggcaggcaaagcctttgcggtcctgtgagcaccgcagctaaccaatggctgttgtacatgtggctcttatggtcacgtgagattccgcaccctcccattcacgtgaagattgagtgctccgaatcctgtcagagaggtgcttccggctccacaccctgactcaggcggaagttttattggacttcggctcagatctgaagccttccggcaactttcatatcctgacgcgctggaaggaagtctggtacgagtggaaccagccggtactagaagtttactgagaattgggctttaaggcgtggctgagcaatctccaaatagcagaggctctgagggggtggggtggggtggggtgggtggggggtgccgggggtgcgggagggtggggggtgcgggaggtgcgggagggtgggggggtggggagggtggggggtgcgggagggtcggggtgtatggggggtttgggtggaggtagcggaggacttccctaatgtggccgaacttgtgaacacctggcagagaaactgtgtgtgcgtgcgtgtgtgtgtgtgcgtgcgcacccatgcatctatgtctgccatccgccttgatcctggactcacaggagctgttgttggaggagaaggcactggggcagaatgtggggctgggggataggggtagggttggtagtggggcggcagggattcatgaactcgtaagtcgtttctcaggggcagggctgtggaagcctgatgggattccccccccttcccgcccccacactaaaagccctacccttgcctgtcactctgcccgattcaccgtctgtgccaggtgattctgtcctctgcccctcctcagaccatgttgttattaaggacactcgagactgcctagatcccagtttgtatagacgattccagacccaatcttaatttctgtctcttatttgattatgtaaagattctctttgtttccatgatttatttttctactaaaccttctaaacatgggctcaggggggtgggcgaaagggagagaggggaatcgggaatttttttaaaaagagaatttgatatttcaataaaagtgtccaagtcgtcatgatgtgaagattcagaatttacttgttatactttatttgaactccattggctttaaaaagtacatttgggagtgggtgacattttttttgtgtgtgtgtgcgcttaggatctctcagtagcttatagtagtatagcttcacactcttttgtttctgattctccccccatcaacccctgattttctaatgattgcttcttagattcctttctgaaaactctctccttttcttcctgtggaaaaaagtatagtgaatggatttaaggtacaatcatgggtgataacatttggtacatcatgaaagcggtattgggtgaatgaagttgagcaaatagcaagattgtgcttaaacttacggggtttcaaatattgcttgtcagatggttagagaatattgtcacttgtgatatttgatattacatgtaggttgaataatctatttttctctcatttcagcatttccaagttcgttctgtgagactgtagtgtcaggacaaagcaacaacaaaatgtgctctactctaaagaagtgtgggacatacagaactgaaggtaaacgaatactgtaggatttttttagatgatatgctaataaacaacacgagtctcaaagggggggctactttccccaacttgtatgggaatggaacatttttttccacagagcatttgaggtaccagtgttcttcagaaaatatttggggaaaccctgttcagactacatcttctaacactttaaaaccttgtgcctttgtttactcagaacaatggaatgtgggtttataatagttgtaatctagtctgctcattaagacattgattgttgctctttaattcattttatctcatgtcatcagtcagtctctcctgcttgaatctttgtacttttttactcttcagagataccgccaagcatgcatctgataccatggtggtggcagacaatatgtgcataaatgcaagtcattaggaagccttacctgtggcagcaaataaagtgcccccactcttgaaaacaaggtacaacttacctgtcaggacaagcagatgcagtaccgctcattttacacaataaaaaaccacacttcttcagaaccattttattattacttaataattacagctgccatagtttgagcccctgtcatatgtcaagcactgtgataacctcggctgtcatgcaagttactgcatttaaccctcaggaaagtcctgagagggtgttatcttaattgacagatgagatatatgagtcaggagaggctgagtgtaacgctgtgcttataggcaacccccaaacctcagtgacttatttctcactcctgctgcatgtttatgccaggtgcatatccttcacgggatggtggatgttgggttctgagccattcttattggaatgactcagagacccaaactaatggagcagccaccatctagaaaggggttactcactgcgtcagagtgggagagagccgtagagggtctcaaaccaacaaccaaaggttctgacccagaaataacccgtgtcactcgtcactcacaacccattggccagagctagtcacatgcacggccctgccccaaggaaggcagtcgggtcgggcagtcctaccaggtgcctggtacaggggagaatgtaaacacttggtaaatggcagcactgactactgcatgaaggaatcaaagctgggagggattaagtacttgcctaacatcacatcggccgtaagtgacagaatcaggatttgaatccacccaggcgtgatttcaaagtcgatgtcctttctgcttctttctacgctgcctgctcttctcttaaaggaagcttatagtaaaaattcttttacatcaatgatgcaatgccctcttccttaatcatctgatagtttaattgaatagacacgatggcactggttaaaaagaccagcactgataagccagaggtcttttccaaatgagggaatgtattggatatttgaatatccattgtattcaattataaaaataaaaccaggtggtagatgaaaggacttttcattgatcatttacttaatgtggaataatccccatgtcttaccgctatgttgaggaaaaatgataaaaaaatagagcctaccttgatgaaagtgaaaacaccatgtgagagagttgaacaaaattgctagatgtcagtgtttcagaagcgcaggataatgataaaatctctggccacacgggcagagaaaattagcgaggtggtgcgggtcagccacttttggaatgaagatagtgtcacacttacagtgacagaaaagattgaaaaagatcacattatgaaaaggatgtgaaaatttgaaaatttagattaaattgatgaattccaggggaaaaatatatataactttccaaactgaaggaatagaaaaccttggtttattcaatgtattcttgacaaggaatacatgcaaaggcaaaattactagccaacccgaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatcaagcgtatgtgccaacatgagactcagaggtggaactgaataacatgggagccatatgtggggtggactacccgtgatgagggaggtctccagttttcatgcggcagccattgcagagtttctagaattcagtctctgtcatgcatgtcaattaacgggcaggcagcagtggtatttcagctgtagcagttccatcacgtgggtggacttctcctggctgtgcagcatccaggcctgcttttctggccctcacagagtttttgtaagctatgtaatatattttattagagatatcttgtttgtataaaagagctagagtgaattctggcataggcaagttgggaccttgattaacagagtacttggcagcaaaattggttgcaagcaaaagaccttgaaggaaatggggatctggggtagatttggcccacagggcatagttgctgacctctaagctaataagttgctgacctctaagctaatagactcactgggtccccaaaacagtgctgagtgggaagtcagcaaaatgaggaggcagctattgctaggatcctctggcaagcataagccaaaaactgaggctttaacacggttgttttcaaccttggttgcacactgcaattcacatggagagttaaaaaatgtggttgcctggatctaaccacggttctgctttgattgttttgggtgtgtcctggtgctagtgaattgtttcagtgtccccaagtggctctaatgtgtaatcatggttgagaactgcttgaacaatttaaatcataagaatgcaagcctttcacaatatttaattttaaaattttataattgtggtttcagaatgataatattacagtaataataaatacatagttacgctggaaaatatgaaataaagattcccatgtaagacatcgagaagattgtctttttcaaagagaaaggaaatgggaaaacacagtggtaaagccggggccaccacaggttgtgtccggcttgaagctaaactgccggcaaggccagagcaaggtatggattaaagctaagtgtctgtgagcccagggctgattcagcagtggagcttcctctgcagaagacatccacaacccaggatcagcaaggaagggatggcacaaactcaacaaatccaataattggcactgagggaacagaaagaatggaagaggctgaaacagacattaagataatatttccccagagagacaaaggagtgataaaggatgaaattgtgtctattacgaaagaatagaagactgcccaagaaagatggctttttgaaggcaaggatctcctttcacttcctcctgaaacttcattaaaacaacatcaaaggtgaacaaattatggtatatccatcaaggggcttttactcagcaaggaaaagtcaagaacatggatgggtctcagaaacattatgccgagttaaagaagccagacccaaaggggtgcagcatgcacaagtccatttgtgtgaaatcctagaacaggaagatgaatatatagtaacggaaagtatatcaatgtttgcacggagccaagggatgaagaggagatcgactggaaaccttttgggttgtgttatatgttctatatcttgattgaggtggtagctagccctaatctctgatttttacatgtaaggaacctgggatcaggagaagttgaatgagtcgtcaaaagtgaggttagcttattaatcagagagaagatattcacacttgattgtcagtaataaacggtttccattatgctgtatatgggtcgataggaaaagtgcttctccccaagcacttgacaaaaccctgacccggccataaacatcctcttatacaagtatgaagcgtaggtgtgaaagtataaccattctgcattccagccacctacttctacacatggttgacattctcacgtgtccctttaccctgacttgtttgtgtttatatttacaaatgaaaacataacttctcattaatattttcttctgaggaatcatactgtaatatacagttttataacctgactttgtttttctttccctttgtatcacgtggcgtgacgagtattctaccttgttgcttatagtctgccacttaaacctgaaacatttcttgcataataatacatttttttttcctgaaagatcggaaacgggaacttaagctccctactgaatccttccgcataacctgtttcatgctctgagctttctgttttggttccctgaacccatatgtcagatgattctccactggagccggggctgccctgttttactactgccgctttgtaagatacattaatagctgacatggcaaccagatgccactcactcatctcttttccttgtcatttccaggaggactaataacaacgaatgcaactaacacgtatttctccctcaataaacgccagatgttgtactacgtt

SEQ ID NO: 4802 - DNA, 102692 bp, human
ctcctcctctgggatcttgaaaacgtagaattcccagaggtagggatgtgtgtttgggcattgccttgttctatggtattcagtgcctccattcaaaccctcctcttctgatgggctgtccttcgctccctcaccagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggtaagattcatagatctctgttagagagggaaatgtgtggtatttgggacataggtaatatcaatactattattgcttattcttcatcacaaaccacacaaaggcccttggaaatgatcttcaaagattttggtatctttgataatttgtattgaggtttgggatacagaaaataaaacttattttccaaagaggagagtgtggaagccagtttgctacaaatattccttatgtgtttgctaaaaatcagtcattatatacgtgattgaatgacagtggatttgtgctatgtatatctagaagttgatcggttggtcagtgatattgaccattcactgcatgtgggggcagggatattataccaaagtacaaggaggagtaggaagtccaagcctcttaatatattagcaatttaattggtggggtaggagaaaaaccatgaaaaatatccaatagagtcttaaaacaacatttaaatacagttgatgggactggagaatgccgagtagatccaaggatggaactgaacccttgcccaatttactttgttttcatcgaagtggcatatggtgctgtgtgtttggatcaggtggtaccttgcgggtaacaatgagtgtatttcatctgcccagtggctaatgctgtcttctggtggcagagagccagaattcttcctggaataggcctggcttgtggtatgaggctctctgggctttgcccctctgccaggcccactctgcattctatcccttattatctaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggtaagaatctccatggtcgtcgtgcagaaaagtggcaagaatgtggggcatgggtgggtagaccttaccctgaatgtgagttacctaagcatttaaaaatgaaaaggcatgatcatttgggaagttttttagctttagtttcctcgtctataatgtgcactgttcaaatagatctttctcaatttggagaatgcatgtatggtttgaagacagctctgtacccaagatatgtcattcacaggtgttggatattatcacgctaaccctatgaagtcattcctggtattttctcttttcttttcttttcttttttttgagacaaagtctcactctgttgcccaagttggagtgcagtgacacgatctaggctcactgcaacctccaccttctgagttcaagcgattctactgcctcagcctcccgagtagctgggactacaggcacgcgccaccatgcctggctatttttttttgtatttttagtagagatggggtttcaccatgttggccaggctggtctcgaactcctgacctcgtgatccgcctgcctcggactcccaaagtgctgggattacatacgtgagccaccacgcccagcccattcctgggtcatattctaaatgtcggccaagatatatggaggaaccctttctctatcctatgctttaagctaccatttgggcccctacgcctctccatggaagtgatgctgagttgggctgtaggacatgttccatgctggaatggaagcagtgaacttggccagcttgctttgaactttaccatctgatcatagcctggattgggtgtatgggcctgaacttggtgcactggctgcaacatgtgttgttactttcaggtaccgggtctacggtcctcttgttaagttaaacgtgccctaggatctcacatacagctacataaagtaatcttatgaacccccagaaatttactacctcagcatcttttgatcatgcattgtcctttgggagattgatggcattccattcccccaaacaaacaaaaatctcatgtatacggtttacccaaatgagcagagaggtcagtgaataactcggttaatgcaaaactttggtgagcagatagagcaaaggcattgtgaatttcttctgtaccgtcttcgttcctcttgtcattgtttttccctgctcacagatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaagaaaatttcagttcctcctgtgttctagctgaagtcaggttctgcagcctcatcccctaactagctgagtgagaatccagtgggccctctgttttcccttcattggctgatcattcttcagtatgcttgcctgagccgaatctgggcatcaggtactgataagggaaaatcctgggactgtatagaataatgccccctgaaaactgggaaggagctaagagaccaaagaatgacccggacaagtccggcttgataagcagatgaatttcttgggacttacgtatagggcattcctgggtggcagcaggacagctctggggatctgccctgacactcctctgcaagctgcttttaagctaattttctggctctttgccttctgtatgcaatgagactctttctcttggtatgtttcccagtacactctgggatgttttggttctcacagacacctcggctcctaagctgggcaccatgcatggccttagaccaccacctggccttcagggttcaggcagcagacatacagccttaagtaatctggtgggggaggggggaactcattaacctacagtcactagcattattttctccattgaaaaatcatttccttgagggctttgaaaactctttgtgagattatccagagaatgactataagggcttctggaagtcagaaattcactgaattgcagatgaagagaagacatagaactccatttctagcaccacatttccctgtagttttcaaggatacagcaatagcaagagttgcgaactcccgttctagtgtctggtttgaagcagtatgaaaactggggattggttgaaagttgatatggtgaatatcaactttgtgccaacaggcattcagctaaggacaggtctcagcttccaagggatttctttcttttaagtgattctaggggtcaggcttggaatctctgataatgacagtaaaccgaagcaattaggtcagtgagtatcatatcaagttcaccccgatcctatttctacagctgaattaatcttatctggccacatctctaggcttagaacatctccttcttcttgacagaatcgatgtgcgtattcaagcgtggggcagctgccatgctttttcccactcctagtctgggactccaactgccaagttatgaatatcagctgacttggcaacacaaatgatagatgttcttggtccacaaggacttgggcttgttgttagagactgcagaggttcgtcccatcgttcccaggccaactgcagcagacaagcagcaatctagaaaattaggaacaaatttaggtttggatttggactaggtttggattcagaatggacaggggacaatagaaacttacttatgggatagacccaaactggttgaaaaaaatcatgtcctcattatttcggcggatggaaggagctgagtacaatttactcagcccaagaaaaacaacagatgagattggagttccattactccccagggaaccacgtgattgatttccctagagggtggataccagatgggtgacatagctgggtaaacagagtgctacttttactttggctggagatgaggcacacagaaaagctgtggaatggatcattcacgtgttctaatcttgtgactagatagtctcaggacagagaccatggcagatgaatgttttataattaataaataggcagtgagcctggcctagttaaattttctaatgtgattagacaatacgaatacaattttttaaaaaagtattaattttgggagccagattatcttacagacaagtgtgttctgaagtgatccctgtgaagatgacggagtagttgacggatactgactttgggctgcaatgaaactttgctttatactttataattaaaatctgacttgtgttgatttcttggagattttgagtttattgattctcttgtgcttctacgtggaggaaatgggaatcctgatcctaaacaaggaaagatagctcactcaattctgttcaccatttagggatggatggatgcacagttagatagataggtggaacatgcacatggttaaaaatgacatgcagtacagagaaaattcggttttttcgccacccctgtatctcatttatcctacttagaggaaactatatccaggtttttgtgcatacttctaaagatattctgtgcatatgcaagtacatattataattataacaaatatttgtgagtgtgtatgcaccaggcactcttttaagcactctacatatattatttcaattattccttaacaatttatctccagtctacttttccaattctagaacaatgttgtacagaaagctctaactgagggtaagaaccggtgtttgtttgtttgtttatatatttatttatctggtcttctttgagtgagtaagggaaaatcatttcactttcttgggctttgtcttcatctataaaattctatacttgactaaattactgattttcttgttcaattttatagagtcatttttcacaaaacgaaatctttccagaagatcacgaataagagagatcaaagctaggcagcttgagttgaagtagagctggaagaaggagttttgaggactgtttcaaaaccactggactagatgatctctaaaggttcctgtattattttcttcttttcttatggctgttgtaacaaattaccccctgaactttgtggcttaaaataacatgcatgtattctcttatcatcctgattgtcagaagaccaaaatcagtttcagtgggtgaaaatcagggagtcagtagggccaggctccctctggaagctctaagggagaatccattgccttgccatttttagcttctgaagctgtattctttattccttggcaaggcaatggattcttccctggagcttccagagctcccattcctttatcatcgaagccagcatcatagcttcttgtgtcagtcatcacattgcctccttctatgtgaaatgtccctctccttccctcttaataaggaaacgctcttacatttagggccaggcaggataatctccccacctcaagatccttagtcacatttgtaaagtcccttttgccatataaggtggcagtcaggggttccagagactacaacatggatatctttggaggccattatttagcttaccacagcctaccctctaactccccaaaattcatgttcattctacatgcaaaatatatttgcctcacctcaatatccccaaaagtcttaacaccaacgcgagttgaaaatctcatctgtaaatcatctaaaccaggtatgagacagactctgggtatgatccttcttgaggctaaatttcttttcatcagtggccctgcgaactagaaaataaagttacctcttttttattacagtggtgacatggacataggataatggttatagacagtccccctcccaacgggaaaaaatgaaagcaagcaaaaagttaccagctccaagccaacttgaaatccaatcaggtaaactcatttaggtttcaaggcctgggaatattcctccgtggctagaggctctgccctctatgcccgaggctccaccctttaagtgaacagagccaggctctgtcctcagagttatcttgtttttgtttttgttttgaagagtaatacatgtttgcagcagaatactttattattattactattattatactttaagttttagggtacatgtggacaatgtgcaggttagttacacatgcatacatgtgccatgctggtgtgctgcacccattaactcgtcacttagcattaggtatatctcctacagctacccctcccccctttccccaccccacaacagtccccagagtgtgatgttccccttcctgtgtccatgtgttctcattgttcaattcccacctatgagcgagaatatgcggtgtttggttttttgttcttgcgatagtttactgagaatgatgatttccgatttcatccatgtccctacaaaggacatgaactcatccttttttatgactgcatagtattctatggtgtatatgtgccacattttcttaatccagtctatcattgttggacgtttgggttggttccaagtctttgctattgtgaatagtgccgcaataaacatacgtgtgcatgtgtctttatagcagcatgatttataatcttttgggtatatacccagtaatgggatggctgagtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgttttttggctgcataaatgtcttcctttgagaagtgcctgttcatgtccttcgcccactttttgatgggatcgtttgtttttttcttgtaaatttgtttgagttcattgtagattctggatattagccctttgtcagatgagtaggttgcgaaaattttctcccattttgtaggttgcctgttcactctgatggtggtttcttttgctgtgcagaagctctttagtttgattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctgcatagggctagccagttttcccagcaccatttattaaatagggaatcctttccccatttcttgtttttgtcaggtttgtcaaacatcagatggttgtagatatgtggcattatttctgagggctctgtttggttccattcgtctatatcccttttttggtaccggtaccatgctgttttggttactgtagccttgtagtatagtttgaagtcaggtagagtgatgcctccagctttgttcttttggcttaggactgacgtggcaatgcgggctcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagcagtttgtagttctccttgaagaggtccttcacgtcccttgtaagttggattcccaggtattttattctctttgaagcaattgtgaatgggagttcactcatgatttggctctctgtttgtctgttattggtgtataagaatgcttgtgatatttgcacattgattttgtatcctgagactttgctgaagttgcttctcagtttaaggagattttgggctgagacgatggggttttctagatatacaatcatgtcatctgcaaacagggacaatttgacttcctcttttcctaattgaataccctttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcttgaagggttgttgaattttgtcaaaggccttttctgcatctattgagataatcatggggtttttgtctttggctctgtttatatgctggattacgtttattgatttgtgtatgttgaaccagccttgcatcccagggatgaagcccacttgatcatggtggataagctttttgatgtgttgctggattcggtttgccagtattttattgaggatttttgcatcaatgttcatcaaggatattggtctaaaactctcttttttggctgtgtctctgcccggctttggtatcaggatgatgctgtcctcataaaatgaactagggaggattccctctttttctattgattgggatagtttcagaaggaatggtaccagctcctccttctacctctggtagaattcggctgtgaatccatctggtcctggactttttttggttggtaagctattgattactgcctcaatttcagagcctgttattggtctattcagagattcaacttcttcccggtttagtcttgggagggtgtatgtgtcgaggaatttatccatttcttctagatttactagtttatttgtgtagaggtgtttatagtattctctgatggtagtttgtatttctgtgggatcggtggtgatatcccctttgtcattttttattgcttctatttgattcttctctcttttcttctttattagtcttgctagcggtctatcaattttgttgatcctttcaaaaaaacagctcctggattcattgattttttgaagggtttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaattcgcctctacacactgctttgaatgtgtcccagagattctggtatgttgtgtctttgttctcattggtttcaaagaacatctctatttctgccttcatttcgttatgtacccagtagtcattcaggagcaggttgttcagtttccacgtagttgaacggttttgagtgagtttcttaatcctgagttctagtttgattgcactgtggtctgagagacagtttgttagaatttccgttcctttgcgtttgctgaggagtgctttacttccaactgtgtggtcaattttggaataggtgtggtgtggtgctgagaagaatgtatattctgttgatttggggtggagagttctgtagatgtctgttaggtccacttggtgcagagctgaattcagttcctggatatccttgtgaactttctgtcttgttgatctgtctaatgttgacagtggggtgttaaagtctcccattattattgtgtgggagtctaattctctttgtaggtcactcaggacttgctttatgaatctgggtgctcctgtattgggtgcatatatatttaggatagttagttcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctatatccagtttgccagtctgtgccttttagttggagcatttagcccatttacgtttaaggttagtattgttatgtgtgaatgtgatcctgtcattatgatgttagctggttattttgctcgtcagttgatgcagtttcttcctagcctggatggtctttacaatttggcatgtttttgcagtggctggtaccggttgttcctttccatgtttagtgcttccttcaggagctcttttagggcaggcctggtgctcacaaaatctctcagcatttggttgtctgtaaagtattttatttctccttcacttatgaagcttagtttggctggatatgacattctgggttgaaaattcttttctttaagaatgttgaatattggctcccactctcttctggcttgtagagtttctgccgggagatccgctgttagtctgatgggcttccctttgtgggtaacccgacctttctctctggctgcccttaacattttttccttcatttcaacgttggtgaatctgacaattatgtgtcttggagttgctcttctctaggaatatctttgtggcattctctgtatttcctgaatttgaatgttggtctgccttgctagattggggaagttctcctggataagtcctgcagagtgttttccaacttgtttccattctccccgtcactttcaggtgcaccaatcagatgtagatttggtcttttcacatagtcccatgtttcttggaggctttgttcgtttcttttttttcttttttctctaaacttctcttcacgcttcatatgattcatttcatcttccattgctgataccctttcttccagttgattgcatcggttactgagccttgtgcattcgttacgtagttctcgtgccatggttttcagctccatcaggtcctttaaggacttctctgcattgattattctagttatccattcgtctaattttttttcaaagtttctaacttctttgccagtggtttgaacttcctcctgcagctcggagtagtttgatcatctgaagccttcctctctcaactcatcaaagtcattctccgtccagctttgttctgttgctggtgaggagctgcgttcctttggaggaggagaggcactctgatttttcgagtttccagtttttctgctctgttttttccccatctttgtggttttatctacctttggtctttgatgatggtgacgtacagatgggtttttggtgtggatgtcctttctgtttgttagttttccttctaacagccaggaccctcagctgcaggtgtgttggagtctactggaggtccactccaaaccctgtttgcctgggtatcagcagcagtggctgcagaacagcagatattggtgaactgcagatgctgctgcctgatcgtacctctggaagttttgtgtcagaggagtacctggccgtgtgaggtgtcagtccgccccgactggggggtgcctcccagttaggctactcgggggtcagggacccacttgaggaggcagtctgcctgttctcaggtctccagctgcgtgccgggagaaccactactctcttcaaagctgtcagacggggacatttaagactgcagaagttattgctgtcttttgtttgtctgtgccctgcccccagaggtggagcctacagaggcaggcaggcctcctggagctctggtgggctccccccaagtcgagcttcctggccgctttgtttacctactcaagcctgagcaatggcgggcacccctcccccagcctcgctgccgccttgcagtttgatctcagactgctgtgctagcaatgagtgaggctccgtgggcataggaccctctgagccaggtgcgggatataatctcctggtgtgctgtttgtgaagcctgttggaaaagtgcagtattagggtgggagtgaccctattttccaggtgccctctgtcacccctttctttgactaggaaagggaattccctgaccccttgcacttcccgggtgaggcgatgcctctccctgctttggctcatgcacggtgcactgcacccactgtcctgcacccactgtccgacactcccctgtgagatgaacccggtacctcagttggaaatgcagaaatcacccgccttctgcgtcgctcacgctgggaggtgtagactggagctgttcctattcggccatcttggctccacccagtttttaatatttaacttcaccactgagtcagaactgaaacagttggtacggaggcctgtgttagtgagactttggcttgccacaaaaccaccctaattgaagaaatgaaaatctgatgtccaagtaagtaatgaagccaatttgaataaagttatttatgtgattgcaaattttaaaaagaacctacgaacgaatacttaaaaaaaaatttaaggtagtgctgtgctttgaatatgtccttcaaagttcatgtgttggatactcaattgctgttgtaacaatgttgagagttaggacctttcagaacagattaggtcatgagggctctgcctcatgaatggattaatgctgttattgtgagactgtgttagttatcatggcagtgggctcctgataaaaggctaagtccaaaccccattttctctttgtctcacacactctatcaccatgtgacaccttcaatgtaccctgccagatactggtgccatgctcttgagacttcccagccgccagaacagtgagccaaataaaattgtcttctttataaattgcctagcctgtgcattctgttatagcagtagaaaacagactatggcaggtaggtagacatattacccaaagagaaacacatctgaaaaatatacaccaatctttttacattgaatatgtatgcatcacagtgatgggatcatatagatggaagatgtagaatgatttcatcttctaaatatacatttataatgtttagtattttttaattaggaaaatttcttgagagaaacacttgaaaatatgtaacagcaaattaacaagaaaacacataaatatttttattttaagaagcgttcatgctatgctgtttttttttaaaagaaagattataataactcttgacttgagagttacccctatctgtgtaggtgtgtgatttgtatattacagttccatcatttagaatgttcaaactctcaatgtgcagacttatcttctgctctctcaggggttggatgtcctctctcagggcatagagacacaataagggattgctgttaagggatggacaattatagaaatttctggttgatgcactgcatatcagtcccttttatcactcccttccccttgcaagctgatctgtcctgagacttttggggttataagtctgactctgacaaacaaatagcatctttgtacattcaatactttaaaaggaaaaggtgtgattctttttttctactcccattccagtggccactaaattatctttcctatttcctttatactttccatgtctgtctctaatatgccctctctgagatggactgcactttttttttctgtcattcagttattttcagatatttttgataactttgtccttccttaagaatatgtgatgcgcaagagtttattaaaactatgtgtggtgaaatcatgcccatccagtagagctcagttctaatgctggcaatttcatgtagcatctgaatgaaccctgacaagcttctacaactcattaagtctcagcaacctaagacaggccaagaagctggtaattctgcctaccagaatcccgttatgaggaacacatggaggaagaaaatgtaatgtaatgcagcaagcacagagcatggcatgcagcaggccctcagagttcccccatgtccgtagctacgagtacctgggttccgggtctcccgactatagttagcttgctctgcaggggtgactcaattggaaacagctccctgggtgttggtggcaaactcagggggcactaagaacaggaagtagagtctcttctggctcccagggctctcctcactatgcccttcgggaaaggacttattttgaaaactccaccttgctcacgtgagcctgacaaaatggtctgaggcctactcttgcctcgtttgacagatcccctcaattttctctgaaccccagctccagatctcacagattctcctcacaaacaccatgtgaagacagtggtgacaggtcactacccacatgccacaccatgggtgaattggtcagtgccaatccttggcctcaggatctcacagggcatgaagggttctgggccccctctcccactccaacccccaggacacccagcagactcactttcagttagagctggtaggtggcaagggcccaggctgagtgttttccattgtcctgaggatgagggcaaagtgaaccctgagatacctgtcttagtccattttgtgctgttataagagaacactcaacactgggtgtgttagtctgttctcacactgctgtaaaaatactgcctgagactcggtaatttataaacagaaaaggttcaattgactcacagttccacatggctggggagggctcaggaaacttacaatcatgggagaaggcgaaggggaagcaaggcttgtctttcatgatggcaggcgagagagagagcgaggaagcgccacactttaaaaccatcagctctcgcgggaactccatcactatcgtgagaacagcacggggaaaaccgcccccatgatccagtcacctcccaccaggtccctccctccacacgtgaggattacaattcaacatgagacttgggtggggacacagagccaaactgtatcactgggtggtttataaagaacagcaatttgtatcttacagttctggaggctgggaagtgcaaggtgggggggcttgcatctgatgagagccttcttgctgtgtcatccaatggcagaaggtgggagggctagagtgcacaagagagagaaagcaagagatcaaactcatagactcaagcccttttataattggtattaatccattcctcaaggtgcaaccctcatatgacctaaacacctcccattaggagggagggttgcactggggattaagtttccaacacatgcttttttggggacacattcaaaccaaccattgcatcctgcccctggccccccaaatttatgtccttctcacatgcaaaatacattaattccatcccagtagccccaaagtcttaactcactccagcacccaaagtccagagtctcatctaaattagagatgggtgagactcaaggcaggatccagactgaggaaaatttcctctagctctgagtctgtgaaatcaaaacaagttgtctattcccaaaatacagtggcgggacaggcgtaggatagacattctcattccaagagggagagacaggcaacagaaaaggcataactgatcctaagaaagtccaaaacccatcagagcaaacaacattaaattttgaggcttgagaataatgttcaagttctgccttctgaggcagggattgggcccccagattctcaggcagccatgcctctatggctttgctaggctcagtccacccagcagctctcacaggttggagtcttgttcctccagctctcccagggtatcattaaatgccagtagctctgaaattctggaatcttagtagcagtccagctcccacacctctactagacattacccgaattgggactctctgcaactgacttgttcccacagccccatcaggtactggcctgatggggactctctctggcagctctgcccctgtggcaggtctctacatgggtcctcaggctgtctgcaacattctgcgaaatctaggtggaggccgtcacagacccatagctcgtgaatgctgtgcacctgcagaatcagcaccatttggatgccgccaaggtccaccgcttgagccttccagaccggcagcctgttcagcacccggccccccttgaactatggctgggacagccgaggagtgctgcacgaaggtgcgggcagcagacacttaaaagcatcacggggcagcagatgttgaggtcccgtgggcgtctctctggaaactttgccttcgcattgtgcactgggcatgtgactggaggagcagcctggaaaactctgaaatgccgtcagggcctttctccagtggtctttgtcttactgaatagcacctgtttcccttctagccatggtaatctcattagcaaagtggtcacttggccatgtctgtagtttgcactcctaaacacgctttttcattctttacatggctagggtgaaatttttcaacatatttaccttcttcctatcttttaattgacaaattccatctttaaagcatttctctcttctctcatttttgtctaagtggccgaacaaagtcacgcagtaccttgaatgttttgctgtttagttatttttactgccagatatcctagttcattaccctgaagttcttttaatttttttcatttttccatttttgtgggtacatagtaggtgtatatatttatggggtatatgagatatgttggaacaggcatgcggtgtgtactaatcacatcacatcccctcaagcatttgtcatgtgtgttacaaacaatctgtatcctcttaggtactttaaaatgtacaattcaactattactgactttaggcaacatgctgtgatatcccaccttattcattctttctgtatttttttgcatccattaaccatccccacctaccccctgcctccacactacccttcccagcctctggtaaccatccttctactctctatgtccacgagatcaatcgttttgattctcaggtcctacaaatcagtgagaacatgcgatgtttgtctatctgtgcctggcttatttcactcaacataaagatctccaattctatccacgttgttgcagatgactggatctcattctttttacgactgaatagtactccattgggtatatgtagcacattttctttatccactcatctgttgatggacacttaggttgcttccacatgttgctattgtaaacagtgctgcaacaaacaggagtgcagatatctcttccatatgctgatttcctttcttttgggtatatacttggcagttggattggtggatcatgtggtagctcaaattttagttttctgaggaacctgcagagtgttctccataatcgttgtactaatttcattcccaccaacagtgtacgagggttcccttttctccacaccctcatcagcatttgttattgcctgtcttttggatataagccattttaactggggtgagaagatatctcattgtggctctaaagatcagtgatattgagcacctcttcatctgcctgtttgccatttgtacgtcttcttttgagaaatgtgtattcaaatcttttgcccattctctaaccggattattagattttctccaatagagttgtttgagctccttgtatattttactggttattaatcccttctcagatgggtagcttgcaaatattttttcccattttgtgggttgtgtcttcactttagtggttgtttcctttgctgtgcagaagctttttaactagtcatgcatgatcccatttgtccatttttgctttggatgccagtgcttctcgggtattactcgagaaatttttgcccagaacagtatcctggagcgtttccccggtgttttcttgtagaagtttcataggctgacatctcagatttacgtctttaatccattctgatttgatttttatataagatgagagataagggtcaagtttcattcttctccatagggatacccagttttcccagcaccagcgccatttattgaagagactgtcctttttccagtgtatgttcttggcacctttgtcaaaaatgagttcactgtaggtgtgtggatttgttcctgggttgcctattctgtcccattggtctatgggtctgttttaatgtcagtaccttgctgatttggttactatagctctgtagtataatttgaagtcaggtaatgtgattcctccagtgttgttcgtttttgctcaggatagctttggctattctgggccttttgtggtactatatgcattttaggattgcttttcctatttctgtaaagaatgtcactggtgtttttgtagggattgcatcaaatctgtggattgctttgggtatgatggacatttaaacaatattgattcttccaacgcatgaacatggaataactttccattattgtgtcctcttcgatttatttcatgaatgtcttccagttttcattgtggagatctttcacttctttggttaattccgaggtatttaattttatttgtgtctactgtaagtgagattaattttgatttctttttcagggtgttcactattggcatatataaatgctagtgatttttgtaggttgattttgtatcctgcaactttactaaattggttgatcagttctaatagttttctggtggagtcttaaggtttttctaaatataagatcgtatcatcagcaaacaaaggtaatttggcttcttcctttccagtgtggatgctctttacttctttctcttacctgattgcttgagcaaagacttcccgtactatgttgaataacagtggtgaatgtgggcatccttgtcatgttccagatcttagaggaaaggctttcactttttccccattcagtatgatactagctgtcagtctgttgtatatgacttttattatgttgaggtatgttccttccatacccagtttgttgaggaattttatcaggaaggaatgttggatttttatcaaatgctttttcagcatcagttgaaataatcatatggtttttatctttcattctgttgatgtgatgtgtcacattgattgagttgcatatgttgaaccatcctcgcatcccagggataaatcccacttggtcatgatgaacgatctttctgatgtattgttgagttgggtttgctagtatttagtggaggatttttgcatcgatattcatcagagatattggcctgtattaagaagtcactgtaagaagatgcctgagagtggatacttggtcagtgtaatgattttaatatgcgccttttctattcttcagaaaatagtctcctttcttatttactttagaatgtcatgacccccaacctatggaattaattaaacaagaaacatttccaatacactatttcacattcagaaggtttcacagtctttcagtgtcaaaccttgtgagcaaagccagggcaacaggctctaagctgacaaaaaagtttaccagtatcttccatagagatggccttttcattcatatagattccatcggcaagtcaggccagacctttcagactctgacttgtaaaaaagtcttgtgtaaggaaaacttaccagtttgcaactagtgtttggtcactgctgagagaaacaaatattaaaaaataaataaatatgtctcagagagttaaataggcatacttggaaacacgaaagcttggaaaatgaatttaatatggcagattttattgagaatgcatcatgagtcataggagttcagaaatcaggaagttcaggaagaagaaaaagatcacaaaggcaagtttatgattacacctactaatcgaggaactgcttgctctgcaaccagtagatgatcacgagatggtcagatcttggtaggcccacaagagatgtcaaaataaaattctcaaaaataaacatcctagagacctccagttctggccaagctggagtttgccctttcctcccagatggtccctctacatcagaacaccctgaatataacagcaaaccagcaaagaaagctctgaaacgtggaaaggggaaagcagaccgactcatgctctcaggactcgagcaagaacacaggcagcgcattcccttggtttttctatttccacccaatatcccagacagggcaccgcagaagcccccagtccagaaccaccaacaatggcagacacaaagctccaagaaaagcctatttcctctgccaaaagaccataaaaaacgtgatctaaaaactgaaaaacctttgtgacaaattcccctcccctacactagacaaacaacaatggaaaaaccttatctcccccaccccccaaggtttcagggaacaagaaggaaacttgtcttctatcctgcctctctgaggcagatggtgatgatccaattcacctgtcagggtagtgtcagtggtgtccagcagcaagatgagccttcaccttcacctgacatcaataacactgaacaaggcagtccaagttgggactagtaagcattccatttatccccatctctggtgtcagtgatgcccagtggaaagttgaacctttacactcatccaaactcaatgaagtggtgtgaggcggggctaatcgacactctgctttcccgctcaggcattctgtgcaagctaggccctatggagagctgtgcctcctcatccacccatcatcaagatggaatcaggtggtgggaggcagggtttgttggcagtctcctttccccctccttcccctgatgttctcagagaccagtggggacctaggcttctgccccaccacactgcagcaacaaaactttgagtcagccatccagttcccctttccctaaagcctagcaaagaactgtgcctatactccccgaccccacctctgaggtaacaaagtgtggtgaattggtgcccccttttttattggaaatgttctcaggggggctagggtagaagttcagctcccacccccagccatctgtgaagaggcaaggtgaaccagcaatctagtttgctaggatggtatcagaacaggaatctgcacttatcaccttatgatatgatgggaccaccatcatatatgtggtctatcattgaacaaaaagtcattatgtggtgcatgactgaatatggactatcttaatgaaatgtcatcacagccttatgaggttaaattttttactattcccagtttaaagatggataataaaagcttggaagagtttacctggccaaggttatttagctacaaagtggtaatgccacggattcaatcctaagatacctgatgcccattaccccatctactgaaagatgacactgtactgcaaaaattaaaacagacatagctgatctgcttctttacctgtaattagagtaaaagaaaacaacaaaagaaaacaaaaacaacacagtgacatgctaactgtcatgaagaaaagtaccacatgtctgataaggtgatcagagatgtacactaagtaaggaaggtagctatagggatatctaaagccaggctgttacagaaaaacactcaacggtatgggagtatgcttgctgagctagtgttagagcaacaaaaaggaggctagtgtggctggagaaaaatccatttattcattcaaagtatccactgaagcaggcattgttataggcacttagggtacattaatgagcaatagacaaagatatttgcccttctggaatttttatttttccaccatgggagacagacaataaaaaacaaaaacagcatatgattaaaatatattgcattccagaagatgactgcgggggggaaaaatcaaatagggaagaagtggaatcaggagtgtgggctgagggttggacattcaaacaaatattggctgctttgcaattgatagtattattagatgggtggaagtcttctcctttgtgccgcctttgccaggcatcagtgtaaatgctctgttggcttcactgcagaggacaacacatttttcctatctttggtcaggactcagttccttctttaatatatcagagaaccagagacactaatatctgacagccttttgccatcaagtggccatgcgttttttaagtaagcatcccctgctacacgtccactaaatttgagcttttaactgtctgtgttgagacgtggcctggtagaaaccctcgctggggccaggcgcggtggctcacgcctgtaatcccagcactttgtgaggccgagtcgggcggattacgaggtcaagagagggacaccatcctggctaacatggtaaaaccccgtctccactgaaaatagaaaaaccagccgggcgtggtggcaggtgcctgtaatgccagctactcgggaggctgaggtaggagaattgcttgaacccgggaggcagaggttgcatgagatgggatcccgccagtgcactccagcctgggcaacagagcgagacgccgtctcaaaaaaaaaaaaaaaaaaaaaaaaaaaaagaaaagaaaagaaaagaaaaaaaaagaaagaaagaaagcaaagaaaccctggctggccagtgcccaggccatacacaatggcattgtgcctcacttttcacctaagacgaaatcagcgggtggggcaggcttataatcagaacacccctccctttccacctcacacactcccacccgcctgtcccacaatccttcctgcccctcccgctctcccacccttggtttctcgaaaccccttctccttccctgccccccgtcccccgagccccaggagggggaggggcaggaatctggctccgcctcccagtatggagatgattggtcaaaggaggtcacctgaccaagctgagccaattgaagtcctctccccactgctttgagaaggaaccgttaagacgctgggccccacccacaagattgcgtcttgtttgtggcaagattctgaggggaagtgtagctcccaggttggttccaagtcttcttccaattaggtaaattacaacaatatcttttccataaatttcctttcttttcttttttgcctttttttttttttttttttttttttgagacggagtttggctcttgttgcccaggctggggcgtaatgtcgcgatctcggctcaccacaacccccacctcccgggttcaagcgattctcctgcctcactcccaagtacctgggattacaggcatgcgccatcatgccaggctaatttttgtatttttagtagagagggggtttctccatattggttaggctggtctccaactcccgacctcaggggatccaccgcctcggccttccaaagtgctgggattacaggcgtgagcgtccgtgcccggcccttctataaattttatataaactaggccttttttggcctacattacctagggtcaaggtttagggattcataggaaaggcaaatccggctggattgctcagtggtccactctccagtccactctctatgtatcccttatcttcacgtgtgattaggttcaattgtatggctaatcacttcatgttctctctttgcaatttctcaggcaggttttctcttcttcttcagaaagttatatttctcttttgcatcttagttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagccactgattttgtcttttaaaattctttactctgaaataattttagacttacagaaaagttacaaaaatgattatacagagagccctcgcctggatttccttaatgttaacatcttatataaccatagaaaaattaccaaaactaactactacattacattgatgcactaattgacattactacatcgatgttaattaccaacagttagcattgatgtagtactattaactaatctacagattttatgtgaatttcaccagatatctcactgatgtcctttttctattctaggatcttatccaggacgcttcattgcatttggtcttcatttctccttagtctcctccaggctgacatttcctcaatctttattggtcttccacagccctgacacttttggagataccagtcaggtattttgtggaatgtctctcaatttgtgtttgtctcatgttttcttatgattagattgaagttgtgcatttgtagcaagcacacctgttttattctcctccctttcccagtggcgagggagggattcccaccctagtgttatgggggcggctgaacacatggtaccctatactggacagacggaatccacagcaatttatcagtaacatttactcacaactggagagaggagggcacctcacgccaggtagagccacacagtgtcacactctggaagagagtgaacaagcaggggctttcagggggaagtctttgtagtaaccagaggatgaagtgaccgttggttcagggtaggacgattggcttgtttgaataattctgcaggctggtggggacctgaaacatgctacccagagataagcaggcactgtgtctgttcaacatgataataaggagggtactttggccagggggcctttctccctgggaacccaatagggaagataacttgtggtgaggccattcagggtcctcctgttctaccccagatgtcaaggcatccatataattggacctctaattttaggtcttatgcgacattaccgcaaacgtgatttcgttcccttctatgtggatcatgtcaggggtacatgacatccataagttgtattactggtggtgctcaccttgatcacttggttaaagtggtgggagttatgctgccccagtgtaatgctactattttcctctttgttagtaataaatatagtgtgaaaagttctttaagaagaaacacaatagatcctcttatattcctgtttcttcgcagactttgacccactactgttaaaatctgtctagggatcttgcctacagcaaatattacctaatggtgattttctgttttcctaatttctgctacatttattaattggaattcctctgtaaggaagagctatctttactccctcattcatttatttcttcaatttatttatctcagtatgggctcttgaataattatgttatacatgccaggcttaatacctaggtgatgggttgatgggtgcagcaaaccaccagggcgcaggtttacctatgtaatgaacctgcacatcctgcgcatgtatcctggaacttgcaataaaataaaataaaaatttaatctaattatatcattattttgttctttgaactgttctagccttggccattgggaagtcattttggttggttctgtggtcttttgatatgaccctatccttttttggtacctttttctggcacaataagatgttcagattcagcatgtgtgtgcccccctcccctcacacacacacaccccttatagccctggattaaaacaacttctacgaggagccccggttccctttcttggggaatgatatttaccaaccagtatctcggtgtgtgttcattattaatggcgtttcattgctgctaaggctctctctatggagagggttaggaaataatgtatgtatacacccatgcctatagacacatccacatttattttggtatctatctgtatgcatagctattaaaagccaggagcttgtattgatactttcaattccaatcattctagacttatttgtagattcgttctccgacctggctttcattatcaaatagtttacatacctgtttatttctggtcagtagatacataaagtagcgcctgaattgctaacaaatgcccctgttgcaaacatattaataacttatatttttgtacagttgtttttgtctttggccttagaggatatagtcaaaatactgctctccaaagttatgtatcttagatcttttcttcctctctccttcagcgtggttaagacactcatttgtaatattgttagttgaacctgtttctgtttgatttggggtaccctcaccccaatatcccggttgattttaattttttatttatattttgggtatgtgcatcattactatgatccaaagagtcagggttatacaaaaacctatactcggagaaatgtcactccttcgtcatcccttctaccctgttcccattccccatttctttccacttctttccctggccctccctgtagggtaatcagcccctttggtttctggtttaacctttcctgtatttattttgcccaaatgagcagatacatacatgttttctcatattcctttcttacacgaaggatagcatactatacatgttcctttgcactttgcctttcctacttaacagcattcttggaaatcactccatattgtttcacagagatcttcatcgttcgtttttacagctgcattgtactccattgtgtggctgcgccacacatagtttattcaaccactcgcctatgtttgggcattttgtttttaatacagaaaccaggtctcgctctataacccaggctgactgaagtgcagtggcacaatcatagctcatggtaacctcaaactcctgggctcaagcaattcacaactgcctcagcctcccaagtggctaggactacaggtgtgtgccaccatgcctggctaattaaagactttttattttttattttattttttgtcgatatggggcctcgctatgttgcccagactggtctggatctcctggcctccagtgatcctcccgccttggtctccaaagtgctgagattacaggcatgagccatggtgcctggcctgtatgggcttttaaattccttccaagattttgcagttacagacattactcccgcgaataaccctggacatgattttttttttttttttgtattggtagaaatgtaccttcaaggtatattcccactggtaggattattgggccaaaagttaagtgcacatgtagttttcttaggtgtttccaagtttctctccagaaggattgtactggttttcatttccattagcaatatatgagaatgacaatttccccacagcctcactaacagaacatgttgccttacttttgaaacttttttctacgggttaggcgagaaatggtgtctcgctgtttctgtaatatacctttgtctaactatgagcaagttttgacacttaaccatatatttgaggactgtttttatactttttgttggaattatctgttcatatctttcccccatatttctattgctgttgtggtccttcatccctcaatatttaagagctctctatatatttggaatattatccagttgtctgcgatatgtgctgcaagtactttacatcaatttgtcagttgccttttgatttatttatgatgcatttgcatcactttcgtttatccttatgtggtcaaatggattgattatttttttctttcattgcctccggaatttgaatcctagttagaaagcttttccctacagtggggttctgccatgttttgttttgttttgttttgttttttctttcttttctttggttgacatggagtctcgctttgtcgtccaggctggagtgcagtggcgcgatctcggctcactgcaacctctgcctcccaggttcaagcaattctcctgtctcagcctctcgagtagctgggattacagccgcccgccacctcgcctggctcattttcgtatttttagtagagacggggtttcaccattttggccaggctggtctcaaactccggacctcaggcgatccacccgcttcagcctcccaaagtgctgggattataggcgtgagccacccccctcccccggccactgccatgttttcttcaagaacttacatggtttcatttgttatgtttagatccctaacccatttgcagtttattcttgtgcatgctgtgttatatggatctacctttatttttccagacgtctcagttgttccaggaccatttattaaatgtccatctttgccctaaagagtttatgtgccatctttatcatgtactaactgtcatatgatttggttgtatttctgagttttctattctagtccactgggctattagtctattcttgcaccagtgccacaatgtcgtaattacagaggctttatagtgtgcttttctggctgatatcataagtcccctctcatagattttctttttcacgtgtttcctggctatgcttgcatgttttcacaaatatattaactttattatcaatttgcctaaatgcataaaaatgtgtgctggcgtttttgcgactgaattaaatttatacaccaatttaggaagaaccgacatctttttaatgctggattattccatctaggacagtgacgtagtctgtttgggctgctattacaaaataccatagactaggtagtttataaacaacagaaatttatttctcgcagctctggagactgacaagtccaagataaagattctggctgatttggtgtctggtgaggaccctcttcctcatcgatggtactttctaattgtatcctcaacatggtggaagggacaaggcagctctctgaagcctcttttatgagagaactaatcccattcataagggctccacccttatgacctagtcgcctctcaaaaggccccacctcctaatggcatcaccttgcgggtaaaatttcctaacctgcacattgtgcacatgtaccctaaaacttgaagtgtaataataataaaataaaataaaataaaaataaaaataaaaaatttcaagatagtaattttgggggtacacaaacattcagaccatctcagatagcgtatgtgtttccatttgttcaagtcttctgtggtgtcattcaggcatatttaaaaatttttcttgtataaatgttgttatcaagtttattcctaaactttaatccttgttgctagtgtatatggggctttgtctgtgaatgtatcctccagctgcttattttttgtgtgtgtattaaaagactgctgattttttgtatgttaattttatattttgctaccttaatgacttcttttactggttcagttgatttatcatcgtttctatagggtttttcaggtatactataatatcatctgcatgtagagatggctttacttctctttgtaaaaagtaagttttattgtgtatatctaaggtatacaacacggtgttatgggacacgtatggatagtaaaatagttactatagtggaacaaattaacataacccattatgtcacatagtgacccatttttggttttggtagcagtaggcgctaaaatctattcatttagcagaaatcccgcatcatacttaatagtacaattgtacaaactgtattccagcatgttgtgcactagatctctagtctctttcatcctacatatctgctactttgcatcctctgacctacatctcccgctttcctcctcccatcccctcctccccaccccgaccctgataaccactgctttattctgtatctctgtatatttgagttttgttttacttttatttttttaagattccacatataagtgagatcatgcaatatttctctttctgtatctggattatttcactattatttcattgttatagcataatgtcctccagattcatccatgttttggcaaatggcaagatctcctttttaaagtgtatacatacaacacattttctgtatccatctgtcccttgatggacacctaggttgtttccatatcttggctattgtgattaatgctgcagtgaacatgggagttcagatacttttcaaagatcagctactttcaaaaggtggttattttatttcctttaagtagatacccagaaaagcagttgctgggtcatatgatagttctctttttcactaccatatttttttctaaaatagaaaaatgtagaactaccattttatttactaaaacagaaaaaaaaaatctatttctttaggtacctccatactgttttccataatgattgtccctatctacattcccatcaacagtgtacaagggttcccttttctccacacactcggcaatgtttgccatctcttggctttttgataatagctatcctaatggttgtatggtgttgcctcatagtagcttttatctgcattttcctgatgattaatgatgttgagcactttttcatacacctgttagtcagtgtgtatgtcttctttggagaaatgtctattcaggtcctttgcccgttgtttaaatttgattgtttttctgctatggagttgtatgatttccttacaaaatttggatgctaaccccttattcatatatatgttttgcaagtatttgctctcaatgtgtaagttgccatttcattttgttgattgttccctttgctgtgctttttagttcttcttattcattcctaggaaaatgatctatttctctgctcagttgactaatacttgtaatgcaagattgaataggtgtgaggtagtaggcatgctttccttgttcctgatcccaagggaaagcttcgagtgcccccccaccccattaaataagttactagcattaggacttaggtatatatgttttatcatgttaagaaagcatcctgtggtgcctattttcttaaggcttttctattttttaacataaagaggtgttgaatttttccaaaggctttttcaacatctgtggtgataaccatatgatatttgtctttaagtatattaatatggtggatgatatcaaggtactttctaatattgagccaatctgtattgatgggataaatcccactttgccaaagtatattatgattttttaaatatgttgtttgctaatattttatctagcatttttgcatctacacttatctatccatgtcacacttgcttcataaaggaagttatgaaaatttcctttataatgctgttgaataatttatagagcattggcactctggtactatctgatctttgaaggtttagtagaattgacctgtaatagcatctgagccaggtgcttcttgggagttattccttaataactttttccatttttttctgtaaaaattggccaagttaagccttccagcattagagtaaaaatcttgataatctgtattttcctaggaaattatttatttcatgtgtatttttaatttctttatacacaggtttgaaaagcaacctaattttttctgtttaaatgattatcatttgtcgtttattattttgtatatttgtgctctctccctttcttccttcattaatctgcctagtgagtttgtccattaaaaaaaaaaccaggattttgatttaataaatatacacacattgtttttctactatgtatcttattaacatctgcttatgtattcattcattcattcattcattcattcattttaatgaccgaatctccctggatcactcagtctggagtgcagcgttgtgatcacagctcactgcagccttgagctcctgggctcaagcaatcttcccacctccgcctcctcagtaagtaggactacaggcatgttccatcacgccctgctaaagaatcattattattattattattactgtagaggcagggtctccttatgttgcccaggctggtctcaaacgcctggcctcaagtgatcctcccgcctcagcctctcaaagtggttggattacaggtgtgagccaccaagcccggcaatttctgcttttatgttatttctttatttgtgtttcttttggtttcccgggttgttcttttattagatttttgaggcagtgctttaatttgtctaattttattcgttcattttcattgatgagagtatttagcgctctgaatctgcttccaatcactgctttaactatcttctacagagtctcatatgtaagctcttataatcactcttcttaaatatttctgtaacttcagttggtatctcgtctttatctcgacatttgcttaatagaagactgaacattttttccaggtagaagagcctttgtgctttcagtttgtgttagtaagttctacttttgttgcatcgtgattgcagagggttggttgtaatatttctactttatggaaattagcgaggccttcactgtgaggtaattatgatcacgttttgttaacgtgccatcagcttttgacaaggtggtatattctttatctccaaggtgtagatttatgtgtgtgtatgtatgcctatgtgtgtatacacacacacaatgtatcttattgtgttgtttacattttcggtataggtctctttattgtaccactggatttgccttgtactgagacttgccatgtattaaatctcctattattactgtgcttcaatgtctccataccttttggcattacaaaggtggttcctatgttatttggtgcataagtattcctaagtattatatattcactgtgaattttcaattttaatgttagcatgtaaactttgtcattaaaaaaattacttttagcacctgctttcttattgaacattttactatctggtccactagtttgtttttaacccccagtctccttttaacactcatctactgccttatgaaaaaaaaaaagtttattctctttttctttctatctctctcacttctcttattttacttgcactatttctttttttccacaatataaaataaatgcacgttagtcattttccttgcttcaccttcattttagtattagataccaaatgcttgccatcagatgttgtagggaagattttcctgtcgttacctgtggaatcacaatcccagtttaccctttagaatataagttagcaaacgttttctgtaaagagccatatggtaaatattccaaccagtgggccatagtttgcagacccttgctctagtggagtcctcaggaagggctgatgggtacataatttcctaagttcctgtctgtttttctataagctgtgatattagtgaaggatcggctgagctggatatcaaatcagtacttcagacgtttttctcagcccatttctgagtttagagttttaagtaatattctaattcaaggcaggttttatatcctcaaatgcttgtttgaatggaattaattctgtttgcagggttgacgtacagttccttctgtttcatggttgtttaatatgtgtgaaatttgtcttctgctctttttctctttctggaatgtttttgtaaggaattatccttccttttgttcatttttatgatattggattgttttaccagattcctattttacaggtgctattttctgtcagtgtagaaaaattcaggcctgaaatttactgatttcgtttgcttgttttggtagcggacaaagaagttatgagtgctctgattctgtggttctcttatgtcttgcaagattcttcattttccccttttgtttcttttccccatcattaccaaagtggcaaagcatgcttctccctttctgtttgcccttactcttacccagaagctgtggatttcaaaggctacttttattttattttattttaatttgagatagagtctcgctctgtctcccaggctggagtgcaggggtgtgatctcggctcactgcaacttctgcctcctgggctccagcgatcctcccacctcagcctcccgagtagctgggaccacaggcgcacaccaccacacttggccactgttttaagttttcgtagagacgaggtctcactatattgcctaggctggtctgaaactcctgggctcagtggtcctcctgcctcgggcctcccaaagtgatgggattacaggcatgagccactgcacccaacccaaagactacattctaagatcatctctacccctttaaattacacgtattttagaggtccttccctgtagtccctgctcttattatctgggacacctttttggtatttttttagacttagtctgggctcagtcattttaactgtagtttcggaccaactttaagtcccttgcctcttcctttctctgtgtctcttgcagcttttcttggtctgtctttgcttgccacaaagactagtgatgagagcatgacagatcttgtgctgggatttcatgccttttctccttttactcactactaaagatttggcattatctgtttctaagtaacgatgaggatgtggcttctgtatagatttacatcttcctttctgattggtttatatccttttgacatgaaacattgggaggcaggtgcctgggtggtcgacattgccttatgctgacttacagctgatttcaaatggcattttatcttatctaaatacatatgtgtgtgtatacacacacagacagacagacaccacacacacacacacacacacacacacacacacacacaccaacacagacatttatacacacatacaagtctatttgtattccatgtctatagtagaggtctcttgaagtggtcgtttgatttaccatatatttgttcaatacatatttcatttattgctatctttggtggcaggcaagagactgtgaaaatcttctcaggatttgttaatgttcctcaccctaaagcaggttcatgtcaatggaccaaaaggtgccagccacactgctagagctcgctgcatggagtctgctgagtgatgagcctgcagctatccatgctcttgaggagctcccatgagacctctttgttccattgttcatcactgccttcttgggtgggcagaagatgaaactaaaggccatggtgaggatttggccctcccgttgtctccatgttggaccgttgagtgtaagggagtcacactatgaaatcttgggagccacgattgatggtcctgcagatcctccctgcccagagctcttcccctcggtaaccctatgtacactagagacatagtgagtcatcaggagggtatgctgcagcctgaggcagggggtggcctaacagtctcccaaaggtggttgacggtgaatgctgaggatctctgtgaggttgttggtccaacacttggggtcaccttaaggactctaatgtcttacagaggtgattatggaatagaggtgattgagagtactattgatggattcacctactgggtatgattacatagaagaacaacatggacaccagactggggaggatcggaggagaaggaaggatgggaaaaacaataaaagatgttgagtttgtacaaaaaaatatttgttggtagattgtttacagagtgaagagcaaagataaagggtttgcccctccttcccctcattgatgttgctgggttatattaaaatcagccacctttcatattctgtctcttcctcttcctgcagacggccaaaacggagggtcctggatttaaagcaggacccagacagcagaaccacatgctctgagatcaggagcacattcccattttgttttcagtcttgcgtttactctcagcactctatcctgaaaatagaagaagccaagcgaagtgttaggtgcctggaaattgtacatttagagtctgagtctcggcccatccagggaacgcatgggattgttagtggacatttcccttgatggtaccttgagaacaaggcaactcttttctttcctttcgagtaaagttgagcagagccttgggtccttgcatctctgctgcagagatttgcaaattcatcaagtgtctgcccacaaaagcgtcctgtagtttctggatctgggatgcactgatcacctggaagtaggtcaggcttgtttgagtgaagtcagcacccttttggcacagaagatccaccaggacagacttagtctatctaaaatccttttaaaatcctgtaaggggagaaacttctcaacttttttcactcatcatgagcagatgaacaacctccaggaactcagcttgtcttgcttctgcctcacagatcagctggacaaaatttccgggtgagaggttggggagggacctgggttccctgaatgccccattacgaacaaaagagtgcgactattcttagatattcttaaacactttgtaacctatttctccttccacatcagcacgggcactgctgggtgttttaaactggccaagctagagagtgtggtccctcatgctgaggagaaagacaggattagaaaagtcagctgtgcccagtcagtcagtcagtcagtcagtcaatcaaccatgtgcagacgtgcagacactaagataagtctgtcgacatattggcgaaaaagacaacagtcctgcttttattggagtgtgtagccttctagagaggaaggggaggcattcagtcggagaaataactgacgctgtagcactgatgcacatccccatgggctggtcacaataggtaataccgccagatcgttttgttcctgtagttttcccgaggcttaggacctgaatggagaacctgtcatttggaaattcgtcaaagggaattctcagtcggctgctttcccagacccatccccatcaaataactgaactagatacactgctaattatactgtaggcactaagttaaattctttttcccttaatctgtcccacaaccctctataataattgctattgtgcacatttgaaagattaaaaaactgtatctcagcgtggaaaagtaactttcttagggtcacaaatctattaagtctgactgtaaagtccacagtgttaactgctgttgcaatggatatacagattactttattctagagtcataagtatctataattcagggctgcttgctctaatccaaccctcattcttcagaaatgccttccttttttctctctacagagccctgccatctcatttgtacacactgtatgtgtctttctgtggactttctaccagagagacatcactgtcctatcccagagctctgaggttacccacctaagactgttgagtctgagtaacaatcagatatcctgggaagtttctgagccattccaggctctgctggagacggtctcagggaccctgcagcatctggagatagacaactgcctgataactgattctactttctctgttgtcatcccagccctgagccactgttcccacctctgtgtccctagctttgtcttcaaccccattacaatgcctgtgctcacgagtcttctgcagcacttaacagcgttgatggagctgaagcatgtgatttatcctgtccctgtccattgctatgaacaatggcaatcacatggcagtttggacatacaagcttgctaaagtgcaggcctcattgaaggtgatgctgcaggcagtaccacagaacgacatgaactagaccacccattctcagtgatcttcacaggacaaggagttgtttcatcactgatgtgtggccactaaaatactgagtgttcttgcctgaagcccaatttgtaaagacacataatgtgccattctgctattccaggaaactggtgttaggaagattggatatgtaactgacctccataaaagaaaaactctaagaaggaaacagcagactttacgaagtcttgtgggtctcttgcccattgtcctctacgtcctccttcttgttactgaccacagtgttgggtacgtgacatgggctgacccagtcgtggcacaccatttccctgtccacactgatcggttcacttatgggtacttgacgcaagtcaggacagttgaaacctttcctggatgtttttctggagtaggtgctggttactgaagccaataatattactcactgaggtcctttaatcttcctgtattcatgattgccttaggttgcttatgacaaaccattggcaattaaaatgaaaaacaagaacaacaagaaacaaactatccccactacctactggtgtctttatcagtatattgctatctcctttcctaggtctcagaagcctggggttcagtttgcccttatttcacacagattcaccaaagatctgttattagctaggtactgttcctggtgctaagaatgaataggcaaacaagaccctacaccaagtcactcacagtacagatcttcctatgttttgtctgtttccccgctcttttcttaggggatttgggaaagttattttgcccatctatggcccagaatttttttttttttttttttttttttttttttttttttttttgctttgccccttgcatactctgctcaatccacattggcctctttatgctgttggatagctcatcaagactcaggccgtagcttagatgttacgtcctccgagaggtttttctcttacttccctctccttacttaccccacttctctcccattacttcccttacttcaccatgctgtttttaaatgtaccatgtacatttccttcatggtacacatcattccatatgtatttgctccctctgctcctcccctagagttgcactattcagtatagtaaacactagccacatgtggctactgagcactagaaatttggctactccaaaatgtgatgtacgataactgtaaaacgcacacggtatattcaagacttagtgagaaacaaaaaatgtagaataactaactaataacttatttgtattgtttacgtgttgaaatgataagttactgcaggtcaaagacagtaaaaaaagaagacagagtactaatgtgtttatattgttcaacatgttgaaatgatagcactgcggcaaagacaatcactctcagcattcctattgaatacctccttggaagacccaaccggtacaataaagcaaaggaaagcactaaaaggcacacagattggaaatgaagtcatgaaaaagtgtccctatttactgacatggtggctatgtataaaatttctgggaatttatgaaaaacctcctagaactaatgagtgagtgtgcctaggttgccgtataccaggtcaatattaaaagtaggtcaactctatttttatatacagtcctccctttgcacagttctgatatgcactaaggtcattcaccgtgatttagttaaataacactagtcccttcacagtatgggtcaaatttcagttaccatggtaaactaactgtcagtaactacataaagaccaaacattgctgctggttcttcagtccacaaatcgctactgaaataacagatgagaatcatgatcagtggccagtcatgtcacttctttcaaattctgtttgtgtcgctccacaaatcactatttaaataatagatgagcatcaggatcagtgaccagtcatgtcacttttcttttaaaatctaatcatgtttggtcactgagtatctattatttatttcatgcatcaacagcaaagaatgaagctgagtttcctccttgtctcccagtgaactactcatatgacattttaccaaagaactggatagtttaaaaaggtaattggccaacaaagacagaaacatgcaaacaaatgacaagaaataatgctggaagtggaaattgcaaaacggttttgatggaaaggattaagatatcccagtgaaagtgacacttgcaaaaaactttacactacaggattccttggagatattcatgacacagaaagaacaaagaataaagttgtggaagctgatcaacactcaaaactgagaaacaaaatttgccaagtcacgggaaaaaatgtctactccatatcacaattaataagatgagaagaaggcaagaactgttcatactactctttttttttccatgagaaattctggatttaattttatttggaatgtcaccaacttctctggcataacatatggtataattatttttagaatgtgattactttatgaatatttgaagacatttttatgttttgagcacttttctgaaacaatagcttctgttttagtgcatagtagtggacaaggccagaattgatgtttttctgtaacattaagctagtaatggtagaagcagttagataaattcaagtcccttgactccagtcacaagacttcctctaaattattgtgactttgtaaaatattcttaatttgaattttttttttattaatccaatagttatttacattgatcttaagtaaaatttgtatgtggcggccaggcacggtggctcacgcctgtaatcccagcactttggaaagctgaggcaggcggatcacttgagatcaggagttcgagaccagcctggctaacatggtgaaaccctgtctctactaaaaaaaaaaaaaaacaaaaaacaaattagtcagttgtggtggcgggcgcctatagtcccagctactcaggaggctgcggcaggacaattgcttgaaacccggtaggcggaggttgcagtgagccgagatcatgccattgcaccccagcctgggcaacagagtgagactctttgtctcaaaaaaaaaaattgtatgtggctacttattgttaatttcactttcattgacatttctactttcacttcacagtgctttaaaaataggcaggccaacattcagattcaggaaatacagagaacaccacaaagatactcctcgagaagagcaactccaggacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgggggccaatattcaacattcttaaggaaaagaattttcaacccagaatgtcatatccagccaaactaagcttcataagtgaaggagaaataaaatactttacagacaagcaaatgctgagggattttgtcaccaccaggcctgccctaacagagcttctgaaggaagcactaaacatggaaaggaacaaccggtaccagccactgcaaaaacatgccaaagtgtaaagaccatcgaggctaggaagaaactgcatcaactaacgagcaaaataaccagctaacatcataatgacaggatcggattcacacattacaatattaaccttaaatgtaaatgggctaaaggctccaattaaaaggcacagactggcaaattgggtaaagagtcaagacccatcagtgtgctgtattcaggaaacccgtctcacgtgcagagacacacataggctcaaaataaagggatggaggaagatctaccaagcaaacggaaaacaaaaaaaggcaggggttgcaatcctagtctctgataaaacagactttaaaccaacaaagatcaaaagagacaaagaaggcccttacataatggtaaagggatcaattcaacaagaagagctaactatcctaaatatatatgcacccaatgcaggagcacccagattcataaagcaagtccttagagacctacaaagagacttagactcccacagaataataatgggagactttaacaccccactgtcaacattggacagatcaatgagacagaaagttcacaaggatatccaggaattgaactcagctctgcaccaagtggacctaatagacatgtatagaactctccacccgaaatcaacagaatatacattcttttcagcaccacaccacacctattccaaaattgaccacatagttggaagtaaagcactcctcagcaaatgtaaaagaacagaaattctaacaaactgtctctcagaccacagtgcaatcaaactagaactcaggattaagaaactcactcaaaaccgctcaactacatggaaactgaacaacctgctcctgaatgactactgggtacataaggaaatgaaggcagaaataaagatgttctttgaaaccaacgagaacaaagacacaacataccagaatctctgggacacattcaaagcagtgcgtagagggaaatttatagcactaaatgcccacaagagaaagcaggaaagatctaaaattgacaccctaacatcacaattaagagaactagagaagcaagagcaatcacattcaaaagctagcagaaggcaagaaataactaagatcagagcagaactgaaggggatagagacacaaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatatcactactgatcccacagaaatacaaactaccatcagagaatactataaacacctctatgcaaataaacttgtaaatctagaagaaatggataaattcctcgacacatacactcgcccaagactaaacctgggaagaagttgaatatctgaatagaccaataacaggctctgaaagtgaggcaataattaatagcttaccaaacaaaaaaagtccaggaccagatggattcacgcccccgaattctaccagaggtagaaggaggagctggtaccattccttctgaaactattccaagcaatagaaaaagagggaatcctccctaactcattttatgaggacagcatcatcctgataccaaagcctggcagagacacagcaaaaaaagagaattctagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatacacaaatcaataaacgtaatccagcatataaacagaaccaaagacaaaaaccatatgatcatctcaatagatgcagaaaaggcctttgacaaaattcagcaacccttcaagctaaaaactctccataaattaggtattgatgggacgtatttcaaaataataagagctatctatgacaaacccacagccaatatcatactgaatgggcaaaaactagaagcattccctttgaaaactggcacaagacagggatgccctctctcaccactcctattcaacatagtgttggaagttctggccagggcaatcaggcaggagaaggaaataacgtgtattcagttaggaaaagaggaagtcaaattgtccctgtttgcagatgacatgattgtatatctagaaaaccccatcgtctcagccccagatctccttaagctgataagcaactgcagcaaagtgtcaggatacaaaatcaatgtgcaaaaatcacaagcattcctataccccaataacagacaaacggagagccaaatcatgagtgaactcccactcacagttgcttcaaagagaataaaatacctaggaatccaatttacaaggaacgtgaaggacctcttcaaggagaactacaaaccactgctcaatgaaataaaagaggatacaaacaaatggaagaacattccatgctcatgggtaggaagaatcaatatcgtgaaaatgaccatactgcccaaggtaatttatagattcaatgccatccccatcaagctaccaatgattttcttcacagaattggaaaaaactactgtaaagttcatatggaaccaaaaaagagcccgcattgccaagtcaatcctaagccaaaagaacaaagctggaggcatcactctacctgacttcaaactatactacaaggctacagtaaccaaaacagcatggtaccggtaccaaaacagagatatagaccaacggaacagaacagagccctcagatataatgccacatatctacaactatctgatctttgacaaacctgagaaaaacaagaaatggggaaaggattccctattttggaaatggtgctgggaaaactggctagccgtatgtagaaagctgaaactggatcccttccttacaccttatacaaaaattaattcaagatggattgaagacttaaatgttagacctaaaaccatagaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccgtcagagtgaacaggcaacctacagaatgggaggaaaattttgcaatctactcatctgacaaagggctaatatccagaatctacaacgaactccaacaaatttacaagaaaaaaacaaaccaccccctcaacaagtaggcgaaggatatgaacagacacttctcaaaagaagacatttatgcagccaaaagacacatgaaaaaatgctcatcatcactggccatcagagaaatgcaaatcaaaaccacagtgaggtaccatctcacaccagttagaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgatgtaaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtagggacatggatgaagctggaaaccatcattctcagcaaactagcgcaaggacaaaaaaccaaacaccgcatgttctcactcttaggtggggattgaacaatgagaacacatggacacaggaaggggaacatcacacaccggggcctgttgtgtggtggggggcacgggggagggatagcattaggagatatacctaatgttaaatgacgagttaatgggtgcaggacaccaacatggcacatgtatacatatgtaacacacctgcacgttgtgcacatgcaccctaaaacttaaagtataataaaaaaaaaaatgacctgttggatttctactttgatgaagttaatgtcatttttaggcctaaaactttttcttttttaaaaaaatcttcaggtgtttttaaattttatttcattttgttttaagttccaggatacatgtgcatgacgtgcaggtttgttatatagacaaacgtgtgtcgtggtttgctgcacctatcagcccatcacctaggaattaagccccgcatgcattagctatttattctgatgttctccctcccccggtgcccccgaccaggccccactgtgtgttgttcccctccctgtgtccatgtgttctcgatgttcagctaccccttttaagtgagaacatgtggtgtttggttttctgttcctgcattagtttgctgaggataatggtttccagctccatccatgtccctgcaaaggaaatgatcttgttcctttttgtggctacatagtattccgtggtgtatatgtaccgcattttctgtatccattctattattgaaggccatttgggttgattcattgcctttggtattgtgaatagggcagcaatgaacatatgcatgcatatatatttataatggtatgatttatattcctttgggtatatacccagtaatgggattgttggttcaaatgatatttctgtttctaggtctttgaggaatcaccacactgtcttccacaatggtggagctgacttacactcccaccaacagtttaaaagcaatcctatttctccacagcctcgccagcatcttttgtttcgtgactttataaaaaccgccattctgactggtgtgagatagtacctcacagtggttttgacttttatttgtctaatgatcagtgatgttgagcttttttttatatgtttgttggccgcataaatatcttcttttgaaaagtgtttgttcatgttctttgcccactttttaatggggttgtttgttttttcttgtaaatttgtttaagttccttgtagattctggatattagacctttgtcagatggatagactgcaaaaatttccacccactctgtaggttgtctgttcactctgatgatagtttcttttgctctgcagaagctctttagtttcattagatcccctttgtcaatttttgcttttgttgcaattgcttttgatgtttttgtcatgaagtctttgcccgtgcctgtgtcctgaatggtattgcctagattttcttctaggatttttatagttttgggttttacatttaagtgtttaatccgtcttgagttaattttggtataaagtgtaaggaaggggtctggtttcagtttactacaggggtctggtttcagtttactacatatggctagccagttctccaagcaccatttattaaatagggaatccttaccacattgcttctttctgttaggtttgtcaagggtcagatggctgtagatgtgcagtcttatttatgagatctctattctgttccattggtctatatgtctgtttttgtaccggtaccttgctgtttcactgtcaagtgctggaaaaagaacaaaaggaactgtctctcattgtcgatggaagtataaaatggccaagacactttgaaaaacaatttggcaggtttgcatgaagttaaaggtacacttatacagcaatcgcactccagggtatttacccaagagaagtgaaatccttcttcccaggaaaccttccagcaaaacgttcttaattgctaaaaactggaaacatctcaaatgcccatcaactggggaatggataaacaaattgtggtatgtacctacactggaagactactcgacaacaagacagttctaagtactgataacataatatgcgtgccacagaatggatgactctcaaaatacattatgctaagtgaaagaagacatactcaaaagactacatacaatgccatttctttggctttatagaaaagggaaaactagagagagaacaaatcaatcagtggttctcttgggctatagaagatcaactttaaaagggcatgagggcactttatggaggtttggacatgtcctagatcttcattcttgggttgatcacatggttgcatgcttttgtcaaaatgcacagaatggtggactgaaaaggggagaatgttatactatgtctcaaaactcggcaccttgattgttattttgtaacctgcctttctccccactgtgtcctgaatcagcaaaaactctatcggttctagggcgtgattcctgctgtaatccccaactctgacagactgtcatccctgtattcctgattctgacctggtttgcctctgatttggaagatatgctttctcagatcctctgccactcttactcattaaccttactcagagcctcctgaaactcactcagtgcaatacaaaggagggatccacagctgcacagaaggtggttgtcagtttctggcttttccatgattcttctgagatgtgttgactaggagtccctgggcttcatccatagattcattctttcaccaaatatgtgttgaacattttccatatgcggtggattctgtcatcatttcctgtttattctccactgcctaacccagaaccagatgttcacgatgtccagttaacaaacgcttctggagcacatatgatgctctaagccctgtgcctggcaccagaaagacagataaattggaaaagaccatctttgtcatctctagcgtcacatgccctccgtggtggacataaagatctattaagcatgtcttttattttctgtgtcgtgatgctttgacatcctgggccttgctgaccctggaaggcttgctcctcccaggcctggtaaggcaattcttagaaatagtaaacaccttgccctggagcgtgcttttcaaatgcaaacaaatcaacggggatacaatacctcccaaccatgtcctatatagggctctcacaccctgggtcactatccacctgccctaatcaccccaaggccaggtaccaggcaactagggacagcccctatgccccaaggctgcttaaattattcagactagccaatcctaaactggttactctcccttgcctgttccttcccacagaggcagagacaacaacaaatgctctggcttgcagttctcctgtctccctctggcccggaccaaccatggtgcttcgccatgagatttcccatgtctgggcatcctttcttctcttcggaactgtgactaacaatctgtctctccaaggcagtcatttcctgatctgtttcaaatgttctactaatccactctattttaaaacactctcagattcccctttaggatgttttcctcgctctgctgggagtgctgtccacagacagccttcagctaccagcttccttggagagcaccttggctccggagagcctccttgtttttccagtggcccacattcagtgactggtggaggcaggagtataaaatcagacatttttaatcaacgtaagaaaaccccaagggtcatttttagcttcagagtaccccatggagctggctgagggtaatgagacctcatagtagctcatttccttccttttccaaattctgtgttctgactgtgctctccacaggtactcatcccatatgtactctcacataaacatcctgcacaataaaatcagtcacacagactatctgttgcagtgcttcaagcatttgaaaaatatggtggagattgtaatggataaataagattctatggctactactaagctcaactgacactctagaagaagacaaagaaatcagagagaaattattatgcacttgaaagccgactgcgaaagccacagggcttccttgggattatacggagactttcaactcctggcacaggatggcagagaaagcttgtgatttaataatcatagaagtaaacctccaaagaaggttaaatttccacccaaagtaggaccgtttctccaggttcatggctcgcactgggcaaaattgagacccataatgtagtttggaatgagacctctagaaacctgaatttccacaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaagaaatcaagactgatgacaggtatactgaagagtttcgcagcccttccaacccctgccacaggaaactcgggatcctttgttcaattcctggacctgaatcaattttttacatctggaactttttgactgaaaaggaggttgggtacccaggcagagaaggtctgtgcagcaccacagcctgtggacacagtaatgattcacccagacctcccctcaagaggcatccatccgttgattcacgtcaccatgaactgtggaaaggaaaatgcccaggtatcttgagaaatgtcaagcatggagtaggagatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcttcctcttcctcttcctcttcttccttcttcttcttcttcttcttcttcttcttcttcttcttcttcttcttcttcttcttctttcttcttctatcccttcaagcatttattctttgagttgcaaacaatacaattgcattccttaagttattttaaaatatacggttaagttattattgactatagtcactgtgttgtgctatcaagtaataggtcttattcattgtttctggttaaccattaaccatctccaccacttccccaactccccactaccaatcccagcctctggaagccatccttctactttctgtgtccatgagttcaactgatttgatttttagatcccacaaataagtgagaacatcagatgtttgtctttctgtgcctggcttatttgccttgacatgacgatctccagttccctccatgctgttggaaatgacaggatctcattcttcttcatggctgaagagtactccattgggtatgtgcaccacattttctttatccattcatctgtcgatggacacttgggttgcttccagatcttagctgttgtaaacagttctgcagcaaacataggagtgtagatatatctttgacatactgatttcctttcctttgggtatatactcagcaatgggattgctggatcatatggtagctcaatttttagtttttggaggaacctccacacggttctccaaatggttgtactaatttacattcctaccaaaagtgtgggaactttcccttttctccacatccatgccagcatttgttactccctgtcttttggatataagccatcttaactggggtgagatgatatcgaatttttgacttgtgtttctcggatgatcaatgatgttgaacaccatttcatatgcctgtttgccatttgtgtgtcttcttttgagaaacgtccattcaaatcttttgcccatctttcgatcagattattagattttttcctatagagttgtttgaaatccttgtatatgctagttattaatctcttgtcagaggagtggtttgaaaatattttctcccattctgtgggttgtcacttcactttgttgattgtatcctttgctgtgaagaagctttttaacttgacgtgatcccgtttgtccatgtttgctttggtcgtctgtgcttgtggggtgttgctcaagaagtctttgcccagacctatgtcctggagatttttcccaatgttttcttgtagtagtttcagagtttgaggtcttacatttaagtctttaatctattttgatttgattttcgtatgtggggagagataggggtctagttgcatttttctgcatatgggtggtccaggttttccagcacgatttatcgaagagactgtcctttctccagtatatgttcttggcacctttgtcaaaaatgagatcactgtaggtgtatggatttctttctggactcccgattctgttccattgttccatgcatctgtttttatgccagtaccatgctgtcttggttactatggctctgtagtattatttgaagtcaggtaacgagattccttcaggtttgttcttgcttaggatagctttagctattctgggtcttttgtggttccatataaattttaggaatttttttttctatttctgtgaatagaaatagtatcaaaataggtattttgatagggattgcattgaacctgtagattgctttgggtattatggacattttaacaatattgattctttcaatccatgagcgtggaatatttttccattttttggtgtcctcttcaattttcttcatcagtgttttatagtcttcattatagagatccttcacttctttggcctagttaattcctaggtgcttaattttatgtgtggctattttaaatgggattactttttaaatttgtttttcaggtagttcactgttgccagatagaaatgctactgatttttgtatgttgattttgtaccatgcaactttactgaattagttgatcagttattagtagttttcttgtggagtcttttttttttttccaaatataagaccatatcatcagcaaacaaggataatttgacttcttcatttccaatttgaatgccctttatgtctttgtcttgtctgattgctctagctaggactcctagtactatgttgaacaacagtggtgacagtgggcatccttgtcgtattccagttcttcaaggaaaggctttcagtttttccacattcggtatgatactagctgtcagtctgttgcatatggcttttattatgttgaggtatgttccttctatacccaggttgttgagggtttttatcaggaagggatgttaaattttttatcaaatgctttttcagcatcaattgcaatgatcatatggcttttatccttcattctgttgatctgatgtaacaccttgattgatgtgtgtatgtagcaccatcctcgcaacccagggataaatcccacttggtcaagattaatgattgttctaatatattgttgaattgggcttgctagtatttggtggaggatttttgcatcaatatgcatcagagacaatggcctgaagttttctttttctttcattctttttgttttctgatgtttctttgtctggttttggtatcagggtaatactggcctggtaaaatgagtttggaagtactctgtcctcctctcctttttggaatagtttgagtaggattggtatcagttcttctttaagtgtttggtagcattcagcagtgaagccattgggtcccaggcttctctttactgggagagtttttcatatggctttgatctcgttacttgttattggtctgttcgggttttggattcaatcttggtaggatgtattgtatctaggaatttgtccatctcttctaggttttccaatttattgacatatagttgctcatagtagtagccactaatgatcctttgaatctctgcagtatcagttgtaatgtctcctttttcatttctgattttatttgcgtgtatcttctttcactttttcttagttagtctggctaaaggtttgtctcatttgtttaacttttcacaaaatcaactttctgtttcagtgattgttcagtgtattgttttcttcagttcaatttcatttatttctgctctcctctttattatttttcttctactaatattgggtttggtttgctctttcttttctagttctttaagaggcatcgttacattgtttatttgaaaattttcctcttttttgatgtaggcacttatagctatgaacttccctctgagtactgcttttgccatatcccagaggttttggtatgttgtgtttccattgccattcgtttcaatttccttcttaatttctgcattgacccactggtcattcaggagtatattgtttaatttccatgtatttgtacagtttccgaaattcctcttgctattgatttctagtcttattctattctatcgtggtcagagaagatgcgtgatattatttcagggttttggaatgttttacgacttgttttgtgacctaatgtatggtctgtccttgagaatgatccatgttctggggaaaagaatgtgttatctgcatctgctggatgaatcgttctgtacatatctgttagatccatttggtctacagtgaagattcagtctgaggtttctttgttgattttctgtctggaagatctgtccagtgctgaaagtggggtgttgaagtctccagctgttactgtgtcagggcccatctctctctttagctctagtaatatttccttcatgtatctgggtgctccagtgttgagtgcatatatatttaaaattgttacatcctcttggtgaatcgacccgtttatcattacatagtgacgttctttttcttttcttatagtttttgtcttgaaatctattttgtgtgatataagtatagcggctcctgctcttttttggtttccattggcatggggtatctttttccatccctttatttttagcctgtgtgtgctttataggtgaagtgtgtttcttctaggcaagagatcaatgagccttgtttcttcacccattcagccagtctgtgacttttgatgggagagtttttccaatttgcatccaatgttacggttgacatgtaaggacgtagtcctgccattttgttatttgttttctggttgttttgtgatcttctcttcattctttctttccttcttgtcttcctctagtgaaagtggttttctctggtgataagatttagtttcttgctttttattttttgtgtatccattgtatttttttttttttttttggtttgaggttaccatgaggctcaataatactatcttataacccattattttaacctgatagcaactgaacactatttgcacaaacaaacaaacataaagcaagcaagcaaaaagaaaactaatgaaaactctgtgccttaacttcatccccccacgttttaatattttgttgtttctatttctatatcattgcattgactatgtctcaaaaagttgttctagttattaatttttattggttcatcgtttagtctttctacttagggtaacacgagtttgtacaccacagttacagtgtcattgtattctgtgttcttctgtgtccttactattaccagtgacttttgtaccttcgggtgataatttattgctcattaacgtccttttctttctgattgaagtacacccctcagcatttcttgtaggataggtctggtattgatgaaatctctcagcttttatttgtctgggaaggtctttatttctccttcatgtttgaaggatatcttctagggtatatactattttagggtaaaagcgttttttgtttttttgtttgtttgttttccttcagcattttaaatatgtcataccaccctctcctggcctgtaaggtttccactgaaaagtctgctgccagacatttggagcgccattgtaaattacttgtttcttttctcttgctgctttcagcatcctttctttatccttgttctttgggagtttgaatattaaatgccttgaagtagtcttctttggattaaatctgcttggtgttctgtaaccttcttatacttggatattgatatctttctctaagtttgggaagttctctgtaattatctctttgaataaactttatactcctatctcttcatctccctcctctttaagcctaataactcttagatttcccccttcgaggctgttttctaggtcctgtaggcatgcttcatttttgtgtattttttcttttgtctcctctgactgtgtattttcaaatagcctgtctgcaggctcactaattctttctttctgcttgatcagttctgctatcgaaggactctgatacattcttcagtatgccagttgcatttttcagctccagaatttctgcttgattctttcagattatttcagtctctttgttaaatgcatctgatagaattctgaattcctactctgcattatcctgaatttctttgagtttcctcaacaaagttgttttgaattccctgtctgaaaggtcacatacctctctgtctccaagattggttcctggtaccttatttagcttatttggtgaggtcgtgttttcctggatggtgctgatgcgaatatttttttcttcagtttctgagtatgtgaactgttaggtattaattgtagtcttcactgtctgggcttatttgtagccgtccttcgtcagaaggcttttcaaatatttcagaggacctgggtgtttggatctaagctgtgtctgcttcagggggcaccccaagctcagtaacgctgtggttcttgtagactcatagagggcaccaccttgatggtcttggacgaggtccgggagaattctctggattaccaggcagagactcttgttccctttccttactttctcccaaacatacagagtctctctctctctctctgtctctgttctgagccacctaaagctgagggtggaatgacacaagcacccctgcagccaccactatgcggccaccactactatgactgcactgggtcagacctgaagccagcacagcactgggtctcccccaaggcctgctgtaattactccttggctactgcctttgtttgctcaaggccctggggctctacaataagcaagtggcaaagccagctaggactgtttttcccttcattggagagaggtcccccaagccccaggtgggtccagaagtgccatctgggaatcagggactagcatcaaaaaccttagaaggctacctgtggttctaagtattgtggctgagctgtcactcaaaccacaggacgcagtctttcccactcttccctccccttcccaaaggtacaagagcctcacactgtagccaccgccaccctaggccccgagcagtactggcagactactgccaatgttcccttaaggctcaaggtctcgtaagtcagctgtcgtgaatgctgcctggcctgggactcacccttcggggcagtgggctcccctgtggctcagggcaggtccagaaatgcagtccaagagtccagtcctggaactggggactccaagggtctgcttgatgctctaccccactatggccatactggtacctaagatgcaaaacgaagtcccctttacttttccctctgcttttctcaaactgaaggagttttgccccatagccaccacttgctggttatgtaccaagtctcacctgaagccaacaagtctcagaggttcacccaaggccctcgatgtagtgcctgggcatcactgctggttattcagggcccaggggctcttcagtttgcaggtggtgagtgctgccaggactaggtcctttccttcaaggcagtgggttcccttctggcccaggacgtgtctaggaatgtcctctagtagctaggtcctggaacaggggccacgtgactctgactggtgccctatcttgctatggctgggctggtatcccagatgcaagacacagtcttcaccactgttttctttctcccctcctcaagtggaaggaaggggtctccttcggagccacaaggtgtgcagcctggggttaggggacgggtgatgccagcactcccttggctgccccagctggtatctcagtatgtcgtgtgaccccccccctcccccgacccctggtccactgtctctgggcctaattcaacaccaggactcacctaagagttgcagttcttttttttgtttgtttttttgagatggagtctcgctctgttgcccaggctggagtgcagtggcacgatctcagctcactgtaagctccgcctcccgggttcacgccattctcctgcctcagcctcctgagtagctgggactacaggtgcccgccaccacgcccggctaatttttttttttttttgtatttttagtagagacggggttccaccgtgttagccaggatggtctcgatctcctgacctcgtgatcctcccgcctcagcctcccagagtgctgggattacagccgtgagccaccacgcccggccagagttgcagttcttatggcctagtctgcctttcaaatttacttggagacacagagtgctgtagcctgccatggtgaggtttgtgggaactcaagttctgatcactgggatcagtgattcccctctggctagggctgctttaaatgctccctctgttgggggggcatgagctgagtttggtccggttttcctttctgctctaacaggatagcactgaggtcattgcttcacaaatgctgtggtctccctccccctgcacccagagatgctctccacaccatgctgctgtggccaggggtgggggaggggtggcgtcggtaattcaggactatgttttggttctcagggagaatgcttccaggttttggcctttgagtaggatgttggctgtgggtttgtcctagatgactcttattattttgaggtatgcttctctgatgcccagtttgttgagggtttttgacatgaagggatgttgaatttcgttgaaaacctcttctgcatctattgagatgatatgtggttttcgtttttagttgcgtttatgtgatgaatcacatttattgatttgcacatgttgaaccaaccttgcatcccaggagtagggcctacttgatcgtgatggattagttttttgatgtactgctggaatcaatttgctggtattttggtgaggatttttgcatctaggttcatcaggaatattggcctgaagtgttgtattttcactgtgtctccgtcaggtttgggaatcagaatgatgctggcctcgtacaatgagttagagaggagtcccagttcctcaaatttttggaatagtttcattagggattggttacagctcttctttctgtgtctgatagaattggactgtgaatccgtctggtccaggcctttggttggtaggtcttttttattactgattcaagtttgaaactcgttattggtctgtccagggattcagtttcatcctggttcaatcttgggaggttgtatgctcccaggaatttatcgatttcctctgggttttctagattatgtgcatacaggtgttcataatagtcgctgaggatttttgttgttgttgctgcatttctgtggggtccgcagtaatgtcacctttgtcatttctgatggtgtttatttgggccttctctctctttctttcttttccttgtttgtctagctagcagtttgtcgagcttatttattttttcaaaggacctttggttcctttggtttctttgaccttttgtagggtggttcacatctcaacttctttcagttcagctctaatatttgttatttcttttcttctgctagctctggggtcactttgctcttgtttctctagttcctctaggtgcgatgttagattgctaatgtgagatctgtctgactttttccatgtaggcacttagcaccataaactttcctcttaacactgttttagctgtgcccccagagattctggtatgttgtacctttgttttcaatagcttcaaagaatttttttgaattctgcccaaattttgctctttactcaaaagtcattcaggagcaggttgtttaatttccatacaattgtttggttttgagacatcttcttggtattaatctctattttcattgcactgtggtccgagagtgtggctggtaatgatttcaggtttgtttttgaattttttgagaattgctttacggccaaacatgtagtcgaccttataatataattgattggttttgaaagatctatatataattgtttgcctctgagagatcttcctgctacagatgtctatttttattgcactgcggtctgagagtgtggctggtatgattccgggtttgtttctgaattttttgagaattgctttatggctgagcatgtggtcgaccttagagtatgtgccctgtgcagatgagaagaatgtatattgtgttgttgtttcgtgcgatgttctgtggatatctgttaggtcaattctgtcaagtgttgagtttatgtcccgaatatctttgttagttttctgccccagtgatctagcactgtcagtggggtgttgaagcctcccactatgattgtgtggttatttaagtttctttgtaggtctctaagtgattgttttgtgaatctgcgtgctccagtgttgggtgcatatatattaaggatagttaagtcttcttgttgaattgaaccctttatcattatgcagtgcccttctttgtcctttctgatcattgtgggtttaaagtctgtttcgtctgaaataagaacagcaacctctgctcttttctgttttccatttgcttgatagatctttctccatccctttactttgagcctatgatgggtgtcattgcatgtgagatgggtctcttaaagacggcatgcagttgggtcttgcttctttatccaacttgccactctctgccttttaagtgggggcgtttagcccatttacattcaaggttaatattgatatgtgaggatttgatcctgtcactgtgccgttagctggttgttatgtagacgtgattatatagttgcttggtagtgtcagtgggctgtgtacttaagtgtgtttctgtggtgacaggcaacgaccttttgtttccatgtttagcgctcccttaaggacctctggtaatgcagatctgggggcaatgagttcccttagcatttgcttgtctgaaaaggattttatttctgcttttcttatgaagcctagtttggttagatatgaaattcccagttggaatttcttttctttaaggatgctgactattggctcccaatctcttctgacttgtaagagttctgctgaaaggtttgctgttagcctgatggggttccctttgtatgtgacctgccccttctctctggctgcttttagtggttttcctttcaccttgaccttggagaatcttatgactatgcatcttggggatggtcatcttctgtagcatctcactggggttatctgactctcctgaatttgcctctctacctgtctagcgaggttggggaaatgtctgtgggcaatatcctcaaatatgttttccaagttgcttgctctctccctctctttgtgggacaccaatgagtcataggtttggtctcttcacataatctcatatttcttggaggttttgttcatttttgttaattctttttttccttgttttagtctgattgatctgattcaaacaactggacatcaggatctgagattatttcctcaggttgttctagcctgctgttaatacttctgattgtattatgaaattcttgtagtgagttttttagctcaagcaggtcagtttggttctttcttaaaatggccatttaatctttcacctcttgtattgttttattggattccttatattccttggctgccatgtcaactttctcgtgaatctcaatgatctttgttgccatccagattctaaattttatgtctatcatttcagccacataggtctggttaagaaccattactgcagagctagtgtggccatttggagacaagaagacactctggcttttagcattaacagagttcttgggctggttcttcctcatctgtgtgggctgacgttcctttaatgtttgaggttgctgtcctgtggatgggcctttttgcttttacattctttgatgaacttgaggttttgatgtggtataagtcaatttagtcaattggcttcatttctggatgattttggggaaccaagacacagctcagcgctcctgggctgcatgctctacccctgggggctgggacgtgtccatggttttttttgtttgtttgtttttgtttttttttttttttctggactctgaaggtttactgcctgctcttctggaggggctgaggtgttcccattccgctggcaacagcactctgatgggatgttccggccaaagtacttccgtggggcagcggtagggcagcaagggcccccaaatgcatgggctcaccagcgaagcagtgcaggaaggctatgagtgagagtgcatcggtggaggagggctgcgggagggtgcacttgtctgcaggggaccacctgcagaagatccccaactgctaggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtggtgaggcttggggttgggtgcccatggccatgcttcagtgcagcttttcccatgctaaaccctctggactccatgcaggcaagatttctatctctgccagctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcagggtctgtgtccttcctccatccattttcaatgccttctttccaaagatctgtttggaatgtgctggtcttcttgatgatcgggtctcttattgggaggagttcttcctgtctgcatctggtcagccatctttgccccaaagccttcagtaatttttaaatctgagaatgtgttaattttccccttcatttttgaaggatggttttgctggatatgtaattcctgcttgacaggtttctccttttttagaactttgaatatatcgcctactgcttgaggactacatatctcttatgagatacagtctccttactagttatagtaaggagttatcagtaataggaattatcagtaatcaaaaccttccaacaaagtcaagtcttgggccagatgacttcattggtgaattctaccaaacatttaaagaagaattaccaccattccttctaaatctcttccaaaaaattgaagaagagggaacacttcctaactcattccataaggccagtgttagttaccatgataccaaagtctgccaaagccacaacaagaaagctacaaagcaatatcccttatgaataccaatgttcagaatcctagatgaaacgctagcaggcagaaccttgcagtatattgaaaggattacacacccatgactgaatgggaataattgctgaaatgcaaagatgattcaacacatgaaaataaacccatgcactatattaacagactgatgataaaagaccgcatcaccatgtcaactgatgcagaaaaagcacctaacaaaatccaacatggttttataataaaaaccctcaacagattaggaagagaaggatacttccttagcgtgacataaaccatatatggaaatacctatagctaacgtcatactcaatggaaaagactgaaaggttttcccctaagatcgggaacaggacaaggatgcctgcttttgtcacttctaactcaacatactattgaaagctctagacagagtaattaggcaagagtaagaaatagaaggcatctaagatggaaaagaagaagttatcccctgtcacagacgacatgatcttctatgtagaaaaccctagagattccacaaaaaaagctgttagggctaataaatgaatttgtcaaagttgcaagatagaaaatcaacacaccataaccagttgcatttgtgtacactgacaatcaacagtccaagaataattaagaaaataattacatttacaatagcacgaaaagaatagaatactcaggagtagacgtaatcaagacatttaccttgagaactacaacactgcttgaagaaattaaagaagacataaataagtggaaagatgtcctgtgttcatgggttgtggttaattttgcgaaaaagtctttcctgctctgaggacataaacttaggcactctcgtaattgttctaacattttttaaaatttcaatagtttgggggcatacaggtggattttgattacgtggataagttcttcagtggtgattcctgagattttggtgcacccgtaacctgagcagtgtacactgtacccaatagatagtcttcttttatccctcaccctctttccacctttccctccgagtcccctaagtccatcatgtcattcctatgcctttgcaccctcataggttagctcccacttataagtgagcgcatacgatattaggatttccattcctgagttacttcacttacagtagtggctttcagctccatccaagttgctgcagaggccattatttcgttccactttatggctgagtagtattctgtggtgtatatatgccacatcttctttatccactcgttgattgatgggcaataaggttgcttccatatttttgcaattgtgaaatatgctgctataaacatgcatgtgcttgagtctttttgatataatgacttgtcttcttttgggtagatacccggtagggggattgctggatcgaatggtagttttacttttagttctctaaggaatctccataccgtttcccagaatggttgtactagtttgcattcccaccagcagtgtaaaagtgttcccttttcaccacatccactccaacatctattattttttgactttttaattatggccattcttgccggagtaaggtggtatctcattgtggttttaatgagcatgtccctgataattagtgacggtgagcattttttttcatatgtttgttggctggttgtatatctttcttttcttttttttttttttttttgagaattgtctattcatgtcctttgcccacttttggatgggattttgcttttttcttgccgatttttattgagtttcttgtagattctggatattagtcctttgttggatgcagggtttgtgaatgttttctcccactctgtgggttgtctgtttactcttctgagtatttcctttgccgtgcagaagctttttagtttaattaggtcccacttgcttatttttgtttttggtgcatttgcttttgagttcgtaggaacgagttcttgtaaatttgtttgagttcattgtagattctggatattagccctttgtcagatgagtagattgcaaaaatttcctcccattctgtaggttgcctgttcactctgacggtagtttcttttgctgtgcagaagctctttagtttaattagatcccatttgtcaattttggcttttgttgccattgcttttggtgttttagacatgaagtccttgccgatgcctatgtcctgaatggcattgcctaggttttcttctagggtttttatagttttaggtctaacatttaagtcttcaatccatcttgaattaatttttgtataaggtgtaaggaaggaatccagtttcagctttctacatatggctagccagttttcccagcaccatttccaaaatagggaatcctttccccatttcttgtttttgtcaggtttgtgagagatcagatagttgtagatatgtggcattatttctgagggctctgttgtgttccgttggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttacagtagttttttccaattctgtgaagaaagtcattggtagctcgatggggatggcgttgaatctataaattaccttgggcagtatggccaaaacaaccccatcaacaagtgggcgaaagatatgaacagacacttctcaaaagaagacatttatgcagccaaaagacacatgaaaaaatgctcatcactggccatcagagaaatgcaaatcaaaaccacaatgagataccatctcacaccagttagaatggtgatcattaaaaagtcaggaataacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacgtggaaccaacccaaacgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcgctcataggtgggaattgaacaatgagaacacatggacacaggaaggggaacatcacacaccggggcctgttgtggggtggggggacgggggagggatagcattaggagatatacctaatgttaaatgacgagttaaggggtgcagcacaccaacatggcacatgtatacatatgtaacgaacctgcacgttgtgcacatgtaccctgaaacttaaagtataaaaaaaaaaggaatgaattcattacctaagccaatgtctgcaagagtttttcgatggtatcttctagaatttttgtggtttcaggtcttagatttaagtctttgatctatcttgagagttgatttttgtaataaggtgagagatgaggatccagtttcattcttctgcatgtggcttgccagttttaccagcaccgtttattgaatagggtgccctttcctcgctttatgtttttgtatgctttgtcaaagatcggttggctgtcagtatttggcttcatttctgagttctttattctgctccattggtctacatacctgtttttatgccagtaccatgctgctttggtaactatagccttgtggtataatttgaagccaggtaatgtgatgcctcctgatttgttctttttgcttagtattgtgttgattatgcgggctctcttttggttccacgtgaatttgaggatatattttttttctagttctgtgaagaatgatcatggtactttgattggaattgcattgaatttgtagatcgctttgggcagtatggtcattttcaccatattgattccacccatccatgagcatgggatgtgcttccatttgtttttgtcattgatgatttctttcagcagtgttttgttgtttttcatttagagacctttcacctccttctttttccactaaggtttcttttttttttttttaatttctggaatttatattgtgtatggagtgagatagcaatctcctctctaaaaaatgggtataaccaatggatccagcactatatattgaatagcctgtcttttcttcagctaaccttcaatggcaaacctctcatgccacgttttcctatatttaatgggctctctatcctatcaattgtattggcctagatgtcatataagtgaactatcttaactatcttaattattaaaacttgatatcttgtaagccatgtcccttctgatcccctctactttgttttaatattcttggatattaagcgcccttggtccttcagtatgcattctagagtcatagagtctattgttccgtagaaagctgtgttggattttttattggaatcacgtcaaatatacaggttaagtggagaaaaccgtcatctttatcatagggattcttccatgagcatgctttatatctgcctaatttggaactaatagctctcgataacatttgataattttctcatttaaagtctgaagcatctttgttagacttatttccatgtaccttactattttgtggcagttataattggtgttcattgaagagttgtttttcctctaagtggttgttgctggtttgtaggaatacagttgattttcttcttagctgtaattaatgctgagagtttgtagattatctcaggtttttccatacaggtaaataatatattgtctatatagatatgatcgtttgggtgtttttaattccaatcattatatcttttatttattgcactggctagaaccgccactgttgagcagaaatgacaatattgagcaaacttgtcctgttcttgatttttaaggacaatccatgtaaatcttcaccagtgtgcacagctgttggtgcagattattttgtagatatgtgttttccatctgttttttcccagtttggcaagaattgtgttttggtttgtttttgtgtgttccgtgaacaggcactggattttatcaaatgattttaccctgtccattaaaatgatagcccaatcttgtttctttccattaatgggatgatttacattaacattcctttctaatgttaaggcatttttacactgctgtgatacaccaaacttgttctggtttattatcatttctgtgcgtcacttaagtctgcagtatttaatttagcatttagcttgaattataaatttcctttctcctattatacttacctcattttagagtcaagattatcctcataaaatatacttgggagtgtaagcttttatcttggtctttggtgaagtttgtatgaacttggaattaattatctactccttgaatgtttagtggaattttccccgtgttcctggtagttttcttgacgttgttttttttttttttgaactaaagatctattttttttaatgtcaacttttatttttagatagaatggttacacatacaggtttgttacatgggaatattgtgtgatgctgaggtttggggtgtggatcccatcacccaggttttgagcatagtatccaataaataggttttcaacccatatcccctccctgccccctcgagtagtccacagtaatttctttaatcgttgttaagtctagtcaagttttctatttcttctatagttagtttaggcaggatatgtttctctttcaaaatttctacgttgtctaggcattaatttatatcagtatgaaattgtttttggtattatcttgtttattgtttatgtctaatcatattctgcttgttaatttttaatattgttcctttgtgttctctctctctctcctcctgtccactgctcttcatctttctcccttcaccagtattgccaacgttggctgtttcgtcagtcttttcagaaaccaacttttggtttggttgattttgttgattctctctattgtacttttctttctctctttctttccatatatatatatatatatatatatatatatatatatatatatatatttagttttgtttgttttttttgttttgttttgttttttgagacagagtctcactctgtcacccaggctagagtgcagtggcgccatcttggctcactacaacctccgcctccctggttcaagcgattctcctgcctcagcttcctgagtagctgggattacctgcgcgtgacaccacgcctggctaatttttgtatttttagtagagacggagtttcaccacgttggtcaggctggtctcgaactcctgaccccgtgatccgcccgcctcagcctcccaaagtgctgagattaccatgcccggcctctattgtacttttcttttatacctcattgctttctcgcctcatattattttttctttttatttttctgcttttcttttgctcttctttcaagcatggatatgactctacacagctgcacccaggggtgacctttaaagacagtgcagagaaaagtatctccctgttgtggggtggggggacgggggagggatagcattaggagatatacctaatgttaaatgacgagttaatgggtgcagcacaccaacatggcacatgtatacatatgtaacaaacctgcacgttgtgcacatgtaccctaaaacttaaaggattaaaaaaaaaaaaaaagaagtctgttgaaaagatacactatggaccttgggctcaaagacctacggtaggaagctctgagtaggatgtgagaaaaatcaatgtgacagtgaaaaacaattattatgtacaactcttttatattctaaagaagggggttaagaataaagatccttgatgtgctgatcagggtgatgagtctgaggattcagtcatcagaatctcacagagataaatggctccacagagaaaagagatttgaagggaatgagactgttcaggaagaacaggagctgatgcccatccatctcatgagggtatgaggaagagaggcaagatagtctaacgcagactgtttggtgacatttcactgggacacgtgccattgaatctcccccgtttgtccccatgaagacgtctacaaatgcgcattgaatgttttggtaatcagatttatcattggtttgggggtggggggtgaatttcagcatctactgtcaagcggggcaagagcaaaggtagctcttggcgccctaatagtactctgcttcaataagttagctgtggtcattgcaaattatgtcagcagaagttgagtggttaaacatgggctttaccttcagagaaacggaacaattctgaaaaagaagaaaagagagaagatccaaacttgccacaggcacatgcagcaggttctccagtcctctttagagtggtttagctgtttaaaaacattgggtgggttctggcacgtgcctagtgttttccactcttaccctgtttatgcacctctgtcctgcttccttgatcagctgcccaccagtcctgagattctcccaacatggatcacttctcagtcattgagaagggaatatgagaggaggtctagatcattatgttcttatttggcagtttaattgttaaaaggaacattcaccaatatactcccacctcgacacccacagaacgtaaaaataaactgttgtaggatgtggtacagtggctcttacagggtatactagagaagaatgaggatgtgaagaaaactggggttcacattgagcctggggtggaaatcctggctgttcagggtggtggaaagtgtagggctgattgccattcctatgatgccttccttgaatcctccggtaagtatccacatcttctagtctctgacttcgaccatatttatcacctctaataccagagttctgaagtttgtttcttgctggattagtttctgtggtcttctaaggacttatgacctatacgtctgttttatagcctataaaattttgctaacatatttttcttggtgtggtgtcgttgtctggtaccttctgattttttgtcccgctttgcaccccccgcccccccccacttcattattaggggttttctggtgggagcataaaaagcatttgcactcagtattcctgaagtaatcagaagtaaattgatagattctctaatgttccactaccctttcattcctggaacgaacgcttttttaatagacatatactagttaagtttagtaataattaatttagaagttttgcatctgtaattatatatactataatttttactgctcgtactgtcctttttgaactttcagtgtctaattttaccagcctcatgatagagactttaaaaataatctcattgactttactgacaaatgtcttattatgtctgaaatataatggatctagaacctgaaaaaattagttaatgaaatgcactgaaatgaatggaaagtaggatactcttctatggtttttaaaaattgaggcatttactgagtcatatagtggcccccgccaaattcctgtccaccctgaacctgtaaatgtggcagtatttggaaatagtgttttttcagacgcagtcacattaagatgagatcatattgaaccaggcagggtaggccctaactccaatatgactgctgtccctataaatagaggtagatttggacaaggagacacagacacataggggagtcgcgtggagacagagacagagactggagtaaggcattacaaaccaaggagtgacaaggagtaccagcatccaccaggaactaggagagctaagaaaggcttcttccgtcagatggagcatggccctgctgacatcttgattttgtacttctagcccccagaactgtgtgagaataaatttatcttgcttttagccacccagtttgggtattttgttatggcagccctaagaaactaatgcagattttagtgctaagacgtgggttgttcctgtcacaaatgcctaaaaatatggaagtggctttgtaattgggtaatgactagaggctggaagacttgaggcacatgatatgaaaaccctagattgccttgaagagaccgttggtagaaatatgaatgctaaaggtgattcttgtgagagctccagaaggaagtgagaagagttgtagaggaagtgcttatcatcttagagaacacgtgtatcattatgaacagaatgatgctagaaatatgaatattcaagctgcttatgatgccgtctgagatggaaattagacacatgttaatgagcactggaggaaaggtgacccttgtgatagagtgtcagaaaacttgaatgaattgtgtagaaagcaggtcttgtaagcgacgaacttggatatttagctaggagatttccatgcaaactctggaaggtgtggccttgtctctttatagtaaaacgtgagagtaaagagataagttgaggaaggaactgttaagccaaaaggaagcacgcttgatgatttggaaaattcacagtctacccagatagtgcactatggaaacagggccaaaagtgtggctgaacagccatttgctaatgagactagctaggcatgtggacccaaccaaccaccttggccctaagccaggaaaccagataggttaatccaggaaggacccacacagagcctacatatctagttgtgtggatccccttggcatctgcaaaaacatggcaaggattttgagagttttatactagcagaaacgctgccagcctggactgaaatgtccagagatgggacaaaaatgaaagaagaatgtctctgaaggcagaaacatggaagaccagaccagaaatggcattgtcattaccctggagggctggatggactgagtccctgacccagaaagccaggaagatggggctgcctccctggagggtcctaaagtttggggctgcctccctgaagggcccttgggacagaagattgagccatggaagttcactctcggcctgaaacttaatggacttttttcctgctgggttgtgaacctgccccagagcgacaacccctttaatctttccaccttctcccttttgtgaaggggacgtctaacctacgtccgtcccactgtagtattctggaagtagataacttgttttctagcttcatgggtctgcagacagagaggaacattgccccagggtggaccttgcccaaagtctactcggtaagatcctgacaattttagatgagattttggatttagggttaatgctggaataggtgaagatctggaggatttggagatggggtgaatataatttactcacggtaagaatgtaaatattggggagccagagggcagactctattgggttgaatagtgcgtgcacccccctccccaaatttatgtctacctggaatctgtgaaggtgattttaattggaagcaaggtctctgtagatgtaatcaagtgacgataaagtcacactggactagggtgtgccctaatccaatgactggtatctttataagaagaggaaaattgggacaaagagacagacacacagggagaataccatgtgacaaccgaggcagagattagggttaagctgccacaagccaaggaatgccaaggattgccagcaaccaccagaagctaagagagatgtgtggtacagattctctctttaactgccaccctcaccacaaggtaccaatcttgctgacaccttgatttcaaacgtttggccaatagaaatgtgagagtttaaaattctgttgtttcaagccacccgtttatggaaatttgttatagcagcctgaagaaacgaatacagcacttgagtcctgtttagcaaggatcaagctagagctctttggtcactgtgtctagcctggtgaacatcagtggctgcttggggcagccatatggacattatttgtgattgtgcatccctgagatgggcctggggatgagcccttgtgagttatgcaaaaaaaaaaaaaaaaaaaaaaaggaaggaccccagcaccccagggagacttaagcatggcaccaagttgcctaacagtcattgtttttcaggcatgggtaccacagttgctgccgtagcatgcattctccttaccctcaagcgtattcatgtgcatagccatggcagccggtgtcccagggactgatgattaaataaagagggtggtggaggaggagcgtttggcactcagctgctcccacagtgctaaaccacttagcccttattctatgcagagctatatctaagtttcatttaattctcacgccaaattgaggatcatgatggaaaattttgtctatagctaaatagaaagctgaaactaagaaaggtcaagtatcatgaagtaaaagagaggttctattagtaatagcaaaaacttggacttcaagcactgtgttcctttcatttgtttttaaattttatttattttttaattagacaaaattgtatatatttacggggtacaatgtggtattttgataagtgtatacatttagaaagactaactcaagctaattaatatatccatcatctcacctacttatcacattttgtgttaagaatatctaaaatctacttttaaagcaatattgaaatatatgatacgttgttattaactctgctcactatgctgtgcaattgatcaccaaaacatattcctcctgtctaactgtgctccagtcccaaatcctcagcagtaaaatgcccctgtctctcctcagtgaaaccactcttgattaataaagtagtcttagtgtagtcttacctggggcttagttgtcccagatctttcctgccatccaccagaacctctttgcctgtagagagtcttctgaacttgagaagctgcaggattatgaaagcccagcatgtcatacacttgcctgctcattgctccttctctcaccttggctctcttgtctctcatagcaatgtcatctcaatatcgggcatcatgaacataactcttccggcctgtcacagaaatgaagcaaataaactgatggaaaaaaaaccataaagaaacccacaataccagccacaagtcaaaccatttaaaactgttacttttgtattagtatcagacaaaatagacgttaagacaacaataattatttggaataaagaaggccaccatgtagtcatgatagaacatttatcaaagagctaaaaagtctgaacttaacatgcactcaaaaacatagccaagaaatacataaagcacgatgttcagagttacaagaaggttgccacaataaaatataaaagtgcactattttagagttggggcagttccaagaagtagcaagatccagggagtgcccctgagcatggcagtcaaataagaggtcttgcgaccatgaggcttggaatcagactggttttctacatggacattgaaatcacccaggactgtgacaagattaggtgtagaaactctgaatgagacataaaaatctttgaccaaaagaccaatacgttggttttattttagaaagccatctttgtaagatgcccaggatggccataaaattgaatgtgtattggtcagggatatttaaactacaactaacagaaagtgcaagtctcgctggcttatccaataggtaaagacacttgcttatataactgagagttcagaggcagagtgagtttcatggttaactgagccagtaacggaaagatgtaaacatccaggctaaatcttgacccaaccactgctggattgggcattggattattggattagattagactaattctgggcccactcttggagctaagaaagtggccatatatcctcaagcacatgactctactgggaggagatacactgatggaggcctgagcccagccaggaaggtgaggaatgtatattgtgtaggtaaacaaaaatgtcacctgcaggtacagactcaaattatatataccgctatgagcatagtaaccacaatattcaagtccttcttgtgtcctaatagagtgactcttcgggtaacaaagacggatattttattcaggagctacctatattgaattcatgaataggcggttacaaagcatgagagctctcccctgtgcagtatatgttttggaagaacctcaacaggcatccactgtgggatgcttaaatcccattttcattctttttcgattcgtcggcaaagttttctattcgctcttgtcctgagatgatgttgtgttaggattatttgaccagaggtaactgaattcttcgtatttaccgttaagttttgtctttctgtaaacacgcgacacagacttcacaaagatatcaaagatcctcagatttcagtatggaacaaccttaaaagccctgggtctttagaagaaagtcagactcagccaggcgcggtggctcacgcctgtaatcccaacactttgggaggccaaggcgggctgatcacgaggtcaggagatcgagaccatcctggctaacgtggtgaaaccctatctctactaaaaatacaaaaaaattagggcttggtggcacgcgcttgtagtcccagctactcaggaggctgaggcaggagaatcacttgaacccgggaggcggaggttgcagtgagccaagatcgcaccactgcactccagcctgggcaacagagcgagagtccgtctcaaggagagaaaaaagaagagagtcagactcctataatgtaccaaaattaaagaacaaccttttcctctaatgcacacatttattcacgctttgaaaagaatatgtttccataacaataccaaatatgcatatgaaaagaaaattaaaaataagataatcacccaatctgcgaatatgcagatttgaaaattaattatcaatatataaatggaagctcttaataaagacgttgtagtatcacatagacaagatatgtaatgtgttattgctcatgttttgccttagtctgcatctacactgtgaaatgagcttaatcgtgttcactggttcattatttgctaactccttgattgacttagccagttgagcaatccagccagtgagtcattctataactgttgataaactacgtgatgttttaaatccaaggattaaaagaaaacacaaacattatatatcttgccttttttcacaggatctaatcactgataataaattatcagtgataagctgatcacaagaaacaaggtataaatgctgcatacactaaaaagaaaacaatgtggctgactatgttttaaaaattatctgacagtattttccaacagagtatttagaactatttcttgaattgcaaaatatagttgccttgagcagataacaggaagcaatctgggaaatttaaaattctctacttttaatacattagaaatctttgaatcataattgctcattgttttaaatggtcttcacagtggagggggtttggaccagagagctgcatcttcacaaatggcactgctcttcagtaaacaccctctatggaatccctaccttttcactcctctccatcctttgcctgaaggaagttttccttgtagacataattttgtatttgtatgttgtggtagtcctcaaagagtgagcctattacctagagctgttgaattttaccttgcattgaggggttggcatattgagcaatttgccagggagcactatctgcaactgcttctctttttttcctattgcttggcactgacataaagttacttctagctacgctaatgaatttcacgaaggaacacagaaaaacaggtcttgaatgtaatgcccgtaatgatagagtcccatcttatgctttcccttgtatgctgttgctaggtcagtcatttttactttctgaaagttaatttacataggacacctagttcaggtgtatgtatctgttcaaaccaaaagcgttagagtatttatgtttaatttaacaacgtcgcaaccgttctgatacttaggggagttctgagtaagtaagttctagaaaggggagttccagtactcccctttctctcttttctgtgttaggtaaagccacccctcctaaagccactagcatggatccccaaaatgtccaccacagaacgaaaaggtaaaagaaggagaagttgttcctgttaaatcctgccgtatcacacgcaagagaaatggcttatcaacctgcctcaccccagtaaacacagcgcctaataaattcagtgcctaaactggaccccggacatatgaatctttgtccacagagttaccttcccccactgtttgtgcatattagagcaccgacagacttccattggtgtaacttaaaaaaaaaaaaatcctaacaaagtcctgataatcatctcagagaaagagtgaatgatatgagtatcaggtctgacaggagcaaactgtgaattaaagtaagagttataattaggatttgtcttttggtgaaagaatttgaccatcatcaataccgtgtaagttccagttgagcataggtgggctagataaaattgtgctgtgccttttactggtgatctgttcatctgtatgtaatgatagaaacgggggccagggcagataccaggtcttgaagtaggcttccatcctgtgactttgtatagatacttcctaaatccaacttgaaatttcataataggctctttcataaatatgtagccccattttatatcctctatttacatgtgtcccataaataattctccagaattatccgagacccactgattggcgcttcctagtcattcattccaattatcatgacttcagtctacggccataccaccgtgaacgcgcccaatatcgtccaaatatcatgacttcctttgataaccttagagccactaacacagcctgttgtcctcactagtatattcaactttaactgtggtggaaaatttggtctgttgagttttcttctgcttatttatgtagccaggccacagtgcgggaacctagcaaagtaatcccaatgcttgtatagcattgtttgcctctgcaagcaaatcagaaagactccactccaccaaatttattttggacatgcaggtgaagctgcagtttcccacacaaaccagcaaaacaggtggtcgtgaaattgcgattaacaacaactgcaatgtgtactctccttctcttttctctatcctttctggggagacacaggcagaataaaaatacagtgaaatctaattataattcagattccactcatacaaaattgttgcagttcaggccagagccaggtatgatgttttaaaagtgctaatctttctcttttcagtaatttttttaaagaaggaaatgttttcagctaacctcaaacattttatactgactttcatatatacatattttatatattaatggtaggtttatatgtatacatttaaatgaatctcctgaggtccttaattagattcagcattgactggtgctaattactgacagtacttgaaatttcttagttggtatttcaaagagaacatccaagacctcaactcttcagtaactgggtctggcttccagtttgtgtgaattaataaggctgaactaaaattaatttcctttggaaaacccgggggtggtcagaacagtctagcaccatactgcctgggggagacagctggtttgccacctgcaatgtctgtgacctcttaggcaagtgatttaacgcctctgtgcttcagtttcctcgtctgtaaaattctgttatactacctactccatagagttagcactcttaaatgcggtaaccttttggagtgtgtggcacatactaatcactatacacatttttctttttcaaatgaacaactaaaattcattaggtttgccctaatttcctttggccctgtatgaaattaagtaaacagtgcttacctgtacggactgcttaggctcttgcagtagtgtctatgattatggttttagtgaggaccttcttcattgtgaagtattaaatttcacgtgttgttagaaatgaaacacataaaatatattaaagagggatggggggccgggagcggtggctcatgctgtaatcccagcactttgggaggccaaggcgggcagatcacctgaggtcaggagttcgagaccagcctggccaacatggtgaaaccccgtctctactaaaaaaatacaaaaattagctgggcgtggtggtgggcgcctgcaatcccagctacttgggaggctgaggcaggagaatcgcttgaaccgggaggcggaggttgcagtgagctgaaatcatgccattgcactccagcctgggcaacaagagcaaaactccgtctcaaaaaaaaaaaaaaaaaaaaaaagtgaggtgagggtagcaaaagctcaagtctgtgtgctgtgggaggttatctggaggtaccaccatctcagtaatatgggcaatctcagagctccaggtctcatgaacagaacggtctcctgaaacatgcagatcaggagaactctgcagtggttggattctactgtcaggaagttgacccaagctcacccacctatcctgggtacttgagccttgcaggatcctaaggctgcaagccacgtggatgccaccatcatgtgaacactacaattatgagccctactgatagggccctactggtcatatcagcaccaagggctctaaaactttgaggtcatgtggcctctcttgtcatgttgctcctatggtcatgtgatgggcccagctcttccagtcactacagtatggtggactcctgaaccctgttgctcacatggattcttccctcacctggccattactggctaccagcatgtggaagtctcagccctcgaagtcatatagatgacctactgtttagggtcatgtggatgctatggtcatgtccactgctcccactcacccctccccatggccacagtgtcaggctcattcctctctgtcacgtgaagattgtgagctgccaaactctgcagatgtgtgtgtgggcagccaagtggctcctgtcatctcgtggcaggcaaagcctttgcggtcctgtgagcaccgcagctaaccaatggctgttgtacatgtggctcttatggtcacgtgagattccgcaccctcccattcacgtgaagattgagtgctccgaatcctgtcagagaggtgcttccggctccacaccctgactcaggcggaagttttattggacttcggctcagatctgaagccttccggcaactttcatatcctgacgcgctggaaggaagtctggtacgagtggaaccagccggtactagaagtttactgagaattgggctttaaggcgtggctgagcaatctccaaatagcagaggctctgagggggtggggtggggtggggtgggtggggggtgccgggggtgcgggagggtggggggtgcgggaggtgcgggagggtgggggggtggggagggtggggggtgcgggagggtcggggtgtatggggggtttgggtggaggtagcggaggacttccctaatgtggccgaacttgtgaacacctggcagagaaactgtgtgtgcgtgcgtgtgtgtgtgtgcgtgcgcacccatgcatctatgtctgccatccgccttgatcctggactcacaggagctgttgttggaggagaaggcactggggcagaatgtggggctgggggataggggtagggttggtagtggggcggcagggattcatgaactcgtaagtcgtttctcaggggcagggctgtggaagcctgatgggattccccccccttcccgcccccacactaaaagccctacccttgcctgtcactctgcccgattcaccgtctgtgccaggtgattctgtcctctgcccctcctcagaccatgttgttattaaggacactcgagactgcctagatcccagtttgtatagacgattccagacccaatcttaatttctgtctcttatttgattatgtaaagattctctttgtttccatgatttatttttctactaaaccttctaaacatgggctcaggggggtgggcgaaagggagagaggggaatcgggaatttttttaaaaagagaatttgatatttcaataaaagtgtccaagtcgtcatgatgtgaagattcagaatttacttgttatactttatttgaactccattggctttaaaaagtacatttgggagtgggtgacattttttttgtgtgtgtgtgcgcttaggatctctcagtagcttatagtagtatagcttcacactcttttgtttctgattctccccccatcaacccctgattttctaatgattgcttcttagattcctttctgaaaactctctccttttcttcctgtggaaaaaagtatagtgaatggatttaaggtacaatcatgggtgataacatttggtacatcatgaaagcggtattgggtgaatgaagttgagcaaatagcaagattgtgcttaaacttacggggtttcaaatattgcttgtcagatggttagagaatattgtcacttgtgatatttgatattacatgtaggttgaataatctatttttctctcatttcagcatttccaagttcgttctgtgagactgtagtgtcaggacaaagcaacaacaaaatgtgctctactctaaagaagtgtgggacatacagaactgaaggtaaacgaatactgtaggatttttttagatgatatgctaataaacaacacgagtctcaaagggggggctactttccccaacttgtatgggaatggaacatttttttccacagagcatttgaggtaccagtgttcttcagaaaatatttggggaaaccctgttcagactacatcttctaacactttaaaaccttgtgcctttgtttactcagaacaatggaatgtgggtttataatagttgtaatctagtctgctcattaagacattgattgttgctctttaattcattttatctcatgtcatcagtcagtctctcctgcttgaatctttgtacttttttactcttcagagataccgccaagcatgcatctgataccatggtggtggcagacaatatgtgcataaatgcaagtcattaggaagccttacctgtggcagcaaataaagtgcccccactcttgaaaacaaggtacaacttacctgtcaggacaagcagatgcagtaccgctcattttacacaataaaaaaccacacttcttcagaaccattttattattacttaataattacagctgccatagtttgagcccctgtcatatgtcaagcactgtgataacctcggctgtcatgcaagttactgcatttaaccctcaggaaagtcctgagagggtgttatcttaattgacagatgagatatatgagtcaggagaggctgagtgtaacgctgtgcttataggcaacccccaaacctcagtgacttatttctcactcctgctgcatgtttatgccaggtgcatatccttcacgggatggtggatgttgggttctgagccattcttattggaatgactcagagacccaaactaatggagcagccaccatctagaaaggggttactcactgcgtcagagtgggagagagccgtagagggtctcaaaccaacaaccaaaggttctgacccagaaataacccgtgtcactcgtcactcacaacccattggccagagctagtcacatgcacggccctgccccaaggaaggcagtcgggtcgggcagtcctaccaggtgcctggtacaggggagaatgtaaacacttggtaaatggcagcactgactactgcatgaaggaatcaaagctgggagggattaagtacttgcctaacatcacatcggccgtaagtgacagaatcaggatttgaatccacccaggcgtgatttcaaagtcgatgtcctttctgcttctttctacgctgcctgctcttctcttaaaggaagcttatagtaaaaattcttttacatcaatgatgcaatgccctcttccttaatcatctgatagtttaattgaatagacacgatggcactggttaaaaagaccagcactgataagccagaggtcttttccaaatgagggaatgtattggatatttgaatatccattgtattcaattataaaaataaaaccaggtggtagatgaaaggacttttcattgatcatttacttaatgtggaataatccccatgtcttaccgctatgttgaggaaaaatgataaaaaaatagagcctaccttgatgaaagtgaaaacaccatgtgagagagttgaacaaaattgctagatgtcagtgtttcagaagcgcaggataatgataaaatctctggccacacgggcagagaaaattagcgaggtggtgcgggtcagccacttttggaatgaagatagtgtcacacttacagtgacagaaaagattgaaaaagatcacattatgaaaaggatgtgaaaatttgaaaatttagattaaattgatgaattccaggggaaaaatatatataactttccaaactgaaggaatagaaaaccttggtttattcaatgtattcttgacaaggaatacatgcaaaggcaaaattactagccaacccgaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatcaagcgtatgtgccaacatgagactcagaggtggaactgaataacatgggagccatatgtggggtggactacccgtgatgagggaggtctccagttttcatgcggcagccattgcagagtttctagaattcagtctctgtcatgcatgtcaattaacgggcaggcagcagtggtatttcagctgtagcagttccatcacgtgggtggacttctcctggctgtgcagcatccaggcctgcttttctggccctcacagagtttttgtaagctatgtaatatattttattagagatatcttgtttgtataaaagagctagagtgaattctggcataggcaagttgggaccttgattaacagagtacttggcagcaaaattggttgcaagcaaaagaccttgaaggaaatggggatctggggtagatttggcccacagggcatagttgctgacctctaagctaataagttgctgacctctaagctaatagactcactgggtccccaaaacagtgctgagtgggaagtcagcaaaatgaggaggcagctattgctaggatcctctggcaagcataagccaaaaactgaggctttaacacggttgttttcaaccttggttgcacactgcaattcacatggagagttaaaaaatgtggttgcctggatctaaccacggttctgctttgattgttttgggtgtgtcctggtgctagtgaattgtttcagtgtccccaagtggctctaatgtgtaatcatggttgagaactgcttgaacaatttaaatcataagaatgcaagcctttcacaatatttaattttaaaattttataattgtggtttcagaatgataatattacagtaataataaatacatagttacgctggaaaatatgaaataaagattcccatgtaagacatcgagaagattgtctttttcaaagagaaaggaaatgggaaaacacagtggtaaagccggggccaccacaggttgtgtccggcttgaagctaaactgccggcaaggccagagcaaggtatggattaaagctaagtgtctgtgagcccagggctgattcagcagtggagcttcctctgcagaagacatccacaacccaggatcagcaaggaagggatggcacaaactcaacaaatccaataattggcactgagggaacagaaagaatggaagaggctgaaacagacattaagataatatttccccagagagacaaaggagtgataaaggatgaaattgtgtctattacgaaagaatagaagactgcccaagaaagatggctttttgaaggcaaggatctcctttcacttcctcctgaaacttcattaaaacaacatcaaaggtgaacaaattatggtatatccatcaaggggcttttactcagcaaggaaaagtcaagaacatggatgggtctcagaaacattatgccgagttaaagaagccagacccaaaggggtgcagcatgcacaagtccatttgtgtgaaatcctagaacaggaagatgaatatatagtaacggaaagtatatcaatgtttgcacggagccaagggatgaagaggagatcgactggaaaccttttgggttgtgttatatgttctatatcttgattgaggtggtagctagccctaatctctgatttttacatgtaaggaacctgggatcaggagaagttgaatgagtcgtcaaaagtgaggttagcttattaatcagagagaagatattcacacttgattgtcagtaataaacggtttccattatgctgtatatgggtcgataggaaaagtgcttctccccaagcacttgacaaaaccctgacccggccataaacatcctcttatacaagtatgaagcgtaggtgtgaaagtataaccattctgcattccagccacctacttctacacatggttgacattctcacgtgtccctttaccctgacttgtttgtgtttatatttacaaatgaaaacataacttctcattaatattttcttctgaggaatcatactgtaatatacagttttataacctgactttgtttttctttccctttgtatcacgtggcgtgacgagtattctaccttgttgcttatagtctgccacttaaacctgaaacatttcttgcataataatacatttttttttcctgaaagatcggaaacgggaacttaagctccctactgaatccttccgcataacctgtttcatgctctgagctttctgttttggttccctgaacccatatgtcagatgattctccactggagccggggctgccctgttttactactgccgctttgtaagatacattaatagctgacatggcaaccagatgccactcactcatctcttttccttgtcatttccaggaggactaataacaacgaatgcaactaacacgtatttctccctcaataaacgccagatgttgtactacgttctcgacatagtaatagacaacttatttatagtgcttgttaggtcacgggcatttctccaggtgcttttcacgtgtttccatgtgttaactcacttaatttttacagtagcccatgaggtagaaactgttactatctttgagttagggggaaaacaagcaaaaagaacttgagtcacagcgaggtcacttagttgccttggatcatagaatttagcaccaggattgaaatcctgatggatctgaccacaaatcctaggcccataaccaataatgtgcgactctgtgtcaaggctgaaatgagcagtacgacagggcccactcaaagtctgctgggcaatgatgggtgtggtttctggaaccaatgtcccgactccagccttctgtccaagagactcatcattgcacagtgttgccctataccatctctccttttttcggactgtgtgggaactgtttctctggtgttcaacttgaagtgaagtaacagggacagacaagatgtacatggacaggaaggaaggagggttttcagaggggagcatatcgccaggatgaattcagttccctggaggcgttttcaatgtgtgtttctttgtcttctctgtactcaccctcttctttctgacccacacatccatcccttggccttttcaccctgtatgtcaggtactcatgccccttccttgccatgtctacttcattgcaagggcagtcatttctacttctccctttgacaatatcagccactctctggtcccgtcatccttctgtcccaaaggacctgtaaagcacagccgtataattatatgtatatatttagacagagagtgatatatgtaataaattcgaaaagtgaaacgtctggatcaaagtgtaagaatgacttctgaatggttaggcatattgcagaaaattagactcacacacggttagtggaagtgtatattggtgtaaatatcattgaaaatccttacgaaaatatcactttatgcttaaaagtactcatgtgcttctcctgggaaactgtagagcagggactcaaaatcttaaacccacttcgaagccctggctgtgttccactgggttttttggccacccctgctgggggtactctgtaaccctggtcaacctgtgggtattgttccattacttttgtgtacagggaactctcctactttcttattttaaaactatcagttcaaatattaaaacaccgagaggtagaaaagaaaaaaagcactaaaaagcatattctgaacaagaaacaaaatttggccatatataatacataacacatgaaaagaaatgtgcagtgggatccagtgttgtgtggcaatgtgtttaccaacatgatttggagtacatgtatctgtaacctaattgtggaagcatgtaatacgaaacactaatacttgctcgcatgggcaacacggacacacagaccacacattcttccctttctctgagacagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggaggtactcagttctatttctaaggatacattaatgaaaaaatattaatgttgcagaagaaaagattaatttgttctagttttgcagtcaggttatgaaatagttctgcagcccgaatagctctggaataaatataaatagaggtcggtagaaatggttcagatggatgtattctcaaaagtggttttgtcgatgatcccaaacctacatcaaatgcattcatttaacaaatattaattaggcccttattctatgccagacactaccagcccaaagtgactcctaatctgaaaacccatggcccaaacagattacacccatctggtccaagacagagatctccaccttatccaagacacctggttcccaccccaacaggagtgactagcacaaaacatcatcccggcctgcttacaaaaaaatctgtcgatgagacctgaaagcttgccatttaagggagaaccagtgcagtctctggaggagcactcagggtatagaggcagaccaatatacgtgaggacataattcctgttctgccacttacctggctgggaaatgtacccgacatctgttaacccaatattcatgatctgaaaagggactgtggataaaattctcatgggatttctgtgaggaggtcaagagaaacctagtgagtctgcccaacactgagcagatgttggttgccactgggcaagggttggttttcttcttatcccgttctttccctgccgtagcagggatgctgatgccatgcactcagtggcatggcagtgatgtaggcagaattccaaactaacacaggaagtaccagtaggaacacacgtgatgtcataaaggttactcaccactatgtctgtgtggggggatcagccagtacatggtgggacttgaggggaaacccaggcggtctgggtgagaagtactagctgctttataatactcttgagatcgcccgtaattctggcagcacaactgcgagacagggattgtgctgagatgccagagttcagcaagtggatgtacgcctgtgtgtgttgtgtcttcggcatctctctctgtccggtccctctgtggctttttatcacatgtgctctcttccaacacaaggccttgcctgaggctgtagctgtagctgttggctagcttacacttttacaccttcttcccctcagtgacgttatttctgaagtaatgtgtgttctcaaaaatgactctgactcttcctgtgctccatatattgaccgtgtgcccttaaccctcactttaatctttgatttttttccctttcatttatggactttcatgaaaatgagttggtttctggacatcctccaaatgtcaccaataggggtctttgttgttgttgttgctgttgttgagtattgttatggactcataactttttaacatactgatgggctccaaaccgcggttaaaggattttgagtaaaggaatgacaagatttgacttatgccttaaaaaatcactctgcctcctgtgttgaaaatagatggtaggggagtcaagggcaaaagcaggacaacttggaaggcagcataatccaggagacagatgttggtgacctggccagggtaggtagcaatggagggggtgagaagtggccagactctggatatattttaaaggtagagccaagagaagatacatccatcctgatcggttggatgtagagtgtgagagaaagagagcactccagccccacttccaagttgtagggaccaagcatcaggaatgtctaggtcagatgctctgcccacatttaatttcacttctaatggcacacagggaaagtcccagcaatcgagaggagcaggactgtcctgacagcgggtcacacacagtgaaagcaatgatgccccctacagaagttcatctgaggcctggccataatcagtatattgcagagaggtcagcagtgaccgaaattttattcataagagtgccctgagacaaggtgtacattttgaaattggtcgaggtctgtttgatggtccaggagatggtctaccttcgtgaatgctgcaagacagtagagggggaaaaaacatacatgctctgtttttgttgttgggtacagtgtgttgggtacggtgttttatttatgtcatttagatcctgttactgtagtggttttcagtatctgctgattttctttccagtaattctgtcacttgcttaggaagagttgtctcttgggctgaaagcatttcgggctgggcaaaaagaaagcttgctctgggtatttcaaactgagtatttttgagggcaaggctggaggcaggagggcagcttgggaagctgttacatcggacccacctgtcattaaagctcgtactgcactggcaaagaggtatagcttgctgattgttcacagaatgcatttggggattggatttgggaggtgcgagagagcttgtctcccaggtgttggtgtggttgttagattagagaagcctgagagaaggcaagattaggaccccttccaggtgtgtggctggtgtctagtctaacccatggacacgcgcacctctgttctttataattcctgctccatttctcaggaggttcaacacagttgcttcctctcccaagattcctaccctgattgtgccacctgtgagataaggctcttgtatctggacaggcagaggagtttgttttctggggcttatgtggcgggttggcactttgctagccctaccatggagttagctcacgacgtggtacgtggtaagtggaccattgatgtgtctcaaacttgtctttttgttctcagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacagtgagtatcttggtggggtctgcattaggtggactattctggaacctgatagaaggaagaccacttaaaacaccctaagttgattatttggaggagagcttcggaatggggggaaagggagtttagggcatctatatttggcacaaaaataagaaatcatgtcagcggtcctttctttagaaatctaagctaagtagaaggttggaaagaaagaaaaaaaaaacccagctggttggttctgttctccatccttagttccacgttgtctctcccttccctcctatttcttctttttacccttagattccttacgggataaagtatgacaaggcatggctaatgaattcaatccagagccattgcagtgaccgcttcactccggttgatgtaagagaggatggtgaagccagatgagtgggcatgggggacggggagaggcctggctcagcaggggccattggcctctgacgctgttgctcttgccttcactccctgtagttccactacgtccgaaatcgggcatgcttctttgtccaggatgctagcgctgcctccgcattgaaggatgtcagttataagatttatgatgatgagaaccaaaaggtgtgtgccgagggcatgccctgtacttagtctctgggcaggaggacaggccagggggctggtcatcctctttgggattagaggtcctggtacttaccaccctgccttcctgcagatatgtatatttgtcaatcattctactgcgccctactctgtgaagaataagttgaagccaggccaaatggagatgctaaaggtaatacagactcaaggatcattgtatgtccacttcctggacccacctcttcttcccctggccccctctttccctgtcaccacaccaccaccaccaccaccatcaccagagccccagagcctctgtcttcatctctatctctgcagctgaccatgaacaaacggtacaatgtctcccagcaagctcttgatctccagaatctccgctttgacccaggtaaggctgacagcagcaattctaagacaagcgggggcagagaggtctgcctgggagggagacttaggaatggcaatttacagaggggttggggctggctctggtccagccagggccctcccagccttccgattcccttctcttggcttcttcaagacttgatgggccgtgacattgatataatcctgaatcgaagaaactgcatggctgccaccctgaagatcattgaaagaaatttccctgaggtgaagccttaggctcagtgctggtatttagttagaggggtggaagggataaggtggagggcagatttgtctctgaggcccaagatagtagccgccactctaactcttcttgacccaaagctgttgtctttgaacttgtgcaacaacaagctgtaccagctggatggcctttctgacattacagagaaggctcccaaagtcaagaccctgaatctctccaaaaataaggtgagaagggggagccagatcaactttgggtggagggcaggacacatcaggataatggcaacagccaggcagtggcacctgtgggtgactatgagggccgggggaattcagggcccagggtcctgggtgtctctctttccctggccctccttctccagtttcctccccatctttcttagctggagtcggcgtgggagttgggcaaggtgaaagggctgaagctcgaagagctatggctagaagggaacccgttgtgcagcaccttctcggaccagtccgcctatgtaaggtcagtggcaaccccggtcacccttcctgggcacctttgctccctgggtgactgagctgtgtctgaaggtgcccttctgcaggaagaagcagccttggtcctctgggaggaccacagacctcccttcctactctctctctctctctctctctcctctctctctgtcactcactcatctgtgcttagaggtctcctttccttcctctgacatggtccccttttcacctgctctggggtgtgtttcccgcctgtctccaccaagcctcctccagtgtgccctctgtgagtgtgctccaggaagtggggctcccccacctccccaggaccagcagtattcagatgctggtgccctggaccgagaagagtcctttagtccggggcttcatgctgagacaggccttcctgcctccatgctgcgatggggcttccctcccctgtcccaagaggggttctccttctcttgctccaaaaaggtccccccacctgtcctgggctggcatgggggcttccctgccccatactgagggctggggccccgggtggctgctgtcatgccatctcttcctctggcccaatgccaggagctgggccctccttggggagaaacctgggtttcctacgtcaaggggccagaagcgggccacgttcctgaggcaggagtggaaggcagagggcagaggaggttgagaagacagaaggacaggcctctcaggcactgccccaccttccctccttctccacctcacatcgtcctgcctgggccctcagaggagccctgggtagcccgagatgggtagcattcctcggtcaaggcgtcagcacagaggggcacaggagtcagggaccatcagaagagaatgcagtggtctggagagggggtccccagactctgaaccccatgctgagctggggcctgactcttcactcctcccgggagaaggtctcctgtccccgtggctgctctgtttcccatgcccagctcagactgagctcacacaggtgaggaaggctccagctgcatccagtgggccccagcccaacaggcgcatgttttcctttcctgcctcggtccccagggccagccagggagcagtgagggaaagggctgcagcaggggagcccttttctcctcttctcctccctgaactccacctccgcagtagagagtctttcccttccctttgcattgcatcctgtttctcccttgtctctcctctcctatgtctcacccatccgtccctcccctaccttcaccccgtttctgttgttgtcccccctgccttccgcttcctgcctcctgagtccggcctcactcacctccgtgtcccagcatcctgggccatccctaagggctgacctggtcttggccagggcctggtcaggcaggttgatggacagccagtgaggtggcagagccctgggctcccaccccatttcctgctccctgcagagccttccatggtgacttgggcaaaggggagggagggagaggaagaaagccctggagcctgggctcccagtgctgcttcttgtagcactggagaaaagggagtcaggacagtctagatggaagctaaccaggaggaaggagagggaggagtgtgagagggagtgggagagagactgtgcaaccctgaactgtcagtcacttcattcaatttttggttttggacagtgccatccgggattgtttccccaagttgttacgcctggtaagtatgtataataccgtcatcattgtctcctcttactcaagaaaaggacctccacgcctgccctcaagtcctttgggtcttgcctagattacatgcttgtatcagaccctcatccattttacaggcatggattcctgaaaaagacaagaatattctccctggaaaatgtgtccccccgccgccaccccccccccacacacacatttgcatgtgatagtagagatgtccagcaccccatgagaaagccacccactggaatttccagggccatttcccacctagcctctgatgcttgtctccctgggcatgttcatcttatcgatcatccagctccatctccttggtctccactgctgacttcctctttccttctccaggacggccgagagttatccgcaccagtgattgttgacattgacagctctgagacaatgaaaccctgcaaggtgaggaagaaggaccaagcaagatttgggttgctgtaagggaggctttgtccaccgcatagatccaaattgtcttttgatttcaggaaaactttactggatctgagaccctaaagcatttagtcctgcaattcctgcagcagtgagtatccctgggaccatgaggaaggggagggctgagacaggctgggccacccgtgcagcctgggagttttcaagtctcatctggggcccaggccacagagatagcctatcctcactgcttccccacaggtattactcgatctatgactctggagatcgacagggtctcctcggtgcttaccacgatgaggcctgcttctccttggctattcccttcgaccccaaggactcagccccgtgagtatcacggctcagaccctgctctggggctgtgtgtctccccagcagacacaggccaactcctggaaatgcccacactggccggaccacccactcctgctcctctttttctcctaggagcagcttgtgcaagtactttgaggatagcaggaatatgaaaacactcaaggacccctgtaagtgtgtgatggggaagagtgggcaaggtaagggggtgtgatgggaacaatcacaggggccaaggaccaggatgtggtagccccccgccctgccccgcccaccctgccattccttgcttctcctctcctctacagacctgaagggggaactgctgaggcgcacaaaacgtgacattgtggactccctcagtgcgttgcccaaaactcagcatgacctcagctccatcctggtggacgtgtggtgccagacggtgagcacctgcttcctcccttgggcaggcccagagagccagaggtgggtaggaggttaaggaggatcctgagcacctgagcgcttccttttcaggaaaggatgctctgcttttctgtcaatggggttttcaaggaaggtgagtgtctgtatagtcccctccccagatcccccactgctccctccccctggctgggctccctctcagaactcccccagcttccctgctttcgttcctttcctttccttcctcttctttcttccgtgttttcccacccccactctgccttcaaaccaccctgatctgacctaggtccatgcctgtctgccctgcacagctcaggcgtgcgttaaggacacagactgtggagtttgacagctctcatcccaggtccttactctgtgaacttgtgctggttacttaacccttcagtttcctcatttgcaaaatggggctaataatctatctcttgggctactgtgaaataggaattaagtgaacttgtggttttcccagggccccacacatgataggggccctgtcactgggagcggattgttcctgttgctgccctccccattcctgccacatccgcctgactccaagtgaacaattgtcctggtctgccccctcccccccttctgtgtgagtgtcaagcaatactctgactggggatcaccgtgtgagcatgttaaagcctgtgcaactctaaggtggtggtgtttgttgtctttgaagtggaaggacagtctcagggttctgttctcgccttcacccggaccttcattgctacccctggcagcagttccaggttagtgctgtgttgtgggtgggagcacccatccaagcttggggccagtgttgtggaaatgtggtgggtgcagtcctccgggtgttctcaatattgtggaaggccgacaggaagatccaaggagcagtctagcctagtgtttaagagtgtgggccctggagtcagaatacagattctgttcctcactccaacactcacaaactgtgtgaccttgatcaacttattcgaccactctgtgattcagtgcctttttctgaaaattggaataagactatccacttccttgggctgttgtacagggtaaatgcgttggggttggatctaaaaatctagtgaagctggtagacagtccctccaaaggtggactctgtgggagggttagagggtaccagccaaaaaatctgggaggcaggcacagttagggatatggaaggaatttggttgttgagtggcagtggttaagaaggatcctgttgttgggggtgcggagttatctacttgtccagtttgagggtgcatttttctttcctccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgagtgctgggagtacatggggatgggggctgttgggacatcagaggaatgagtaatggaaactcacatgcaatttggaaaaataactatctgggtattttgcttccaaaaaaagtgggtccatgaaaaaggtatcatacttttatactggtatatgtaaatatttttttaaatggcataatgcccaaatgacattaccttccatttgtaaaatctgaaagaatcaaccacaataaactactgataaaccaggtcagcaaggttgaaagatacaatatacaaaaatcatttgtacttctatgtagttgcaatggacaatccaaaaaaatgaaattaagaaaataagtccatctacagtagcatcgaaaagaagaaagtatgtaggaacaaaattaagagaagaagcgcaaatcttgtactctgaaatctgcaaaacattgctgaaaaaaattaaagaagacctaaatacgtggaaaggcatcccacgttcatagattggaagacttaatatcattacgatggcagtaccacccagaacaatctacagattcattgcagtccctgacagaatcccaactgacttctttgcagaaattgacaaggtaatcccaaaattcatgtggaaatgcagtggaccccaaacagccaaaaccatcttgaaagagaagaacaacgttagaagactcacacttcccgatttcagaacttgctacaaaactacattaatcaagactgtatggtaccgacataggaacagacgtgggaatcaatggaatataattgagagtccacagataatctcacgtatttatgtccagttgattatcattcagggtgctgaaaaaatccaatggagaaaaaaaatagtcttcttaacaaatggtgctgggagaagtggatatccacttgcaaaacaattaattttgacccctaactcacatcacgtgcaaacactggcagaaaatggatcaatgacctaaaataagagccagaactgtaaaacactgtaagtgtacatcttcattaccttgaattaggcaaccatttcttacatatgaaaccaaaagcacaagcaaccaaagaaaaaataggtaaattggacttcatctaaattaaaagcttttgtgcatcagcagacactatcaagaaagcggaaaaccgactggtgggaacaagggaaaatatttgcaaatcacatcgccgacaagaagaacccttacaactcaacaacaaacagacaagccaccgaattaaaaaatggggaaatgatttgaatagatgtttctccaaaggagatatacaaatgaccaagaagcacgtgaaaatcttctcaacatcgttagtcattagggaaacgcatatcgaaaccacagtgagttaccacttcatacccactacgctagctttagtccataaaaggaaacatgacaaatgtcggtgagaatgcagagaaattggaaatctcatgtattactactgggaacataaagtggagcagttgctggcaaaaagattttggcagttcctcaaaatcttaaacatggagttaccacatgatccagtaatcccactcctaagtgtataccaaaagaaatgaaaatatatgcccattcaacaacttgcacatgaatttccgtagtggcattattccaaatagccaaaaaatggaaacacatggattgaccttcagctgatgaatggataatgtggtacatccatacggtggaatattattagaatattattcatccacaaaaaaggatgtagttgtgatatatgctatgacgtggatgaaccctgaaaacattatgtgctaagtgggagcacccagtcacaaaaagccacataattatatgattccattcatacgaagtgttcagaatagccagatccgtagagaccgaaagcagagtagtggttgccaagatctggggaagagggagaacagggagtgatctctaacagttaaggagtttctttttgaggtgataaaaacagtttggaattagataggtgtgatggttgcacaatcttgtgaatagacttaaaagcactgaattgtacaccttaaaatggtgactgctacagtatgtgcattatatctcaatagaaaagaaacgtattattgaatttccacttgttatttcttgaacatctttctttatcaatatgtattaagctcccttgttcatttgaataccgctatgtttctgatttgaattctagtgggcattaatgtcagggatgggcgttttggttttccccaggccttttttcattgttacaatagtgctcatattggtacatgtgacccagcaaaaaggtagcatagattaagggtggcattgcatagtcagcgtgtctgtcctgggctagtaatggagagcacctgttcttctcccaccccaggtgccttcaggacaatgagtggaactacactagagctggccaggccttcactatgctccaggtgaggtctgggaatcaagtgggtaaaagacagctgtctctgggtcgtcaggagggccaagaagatggaggccaggtagtgtggggatggaacccagtgcacctggctctactaacatcccaactccttttctttactttctctagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 4803 - DNA, 102805 bp, human
ctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagaggtagggatgtgtgtttgggcattgccttgttctatggtattcagtgcctccattcaaaccctcctcttctgatgggctgtccttcgctccctcaccagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggtaagattcatagatctctgttagagagggaaatgtgtggtatttgggacataggtaatatcaatactattattgcttattcttcatcacaaaccacacaaaggcccttggaaatgatcttcaaagattttggtatctttgataatttgtattgaggtttgggatacagaaaataaaacttattttccaaagaggagagtgtggaagccagtttgctacaaatattccttatgtgtttgctaaaaatcagtcattatatacgtgattgaatgacagtggatttgtgctatgtatatctagaagttgatcggttggtcagtgatattgaccattcactgcatgtgggggcagggatattataccaaagtacaaggaggagtaggaagtccaagcctcttaatatattagcaatttaattggtggggtaggagaaaaaccatgaaaaatatccaatagagtcttaaaacaacatttaaatacagttgatgggactggagaatgccgagtagatccaaggatggaactgaacccttgcccaatttactttgttttcatcgaagtggcatatggtgctgtgtgtttggatcaggtggtaccttgcgggtaacaatgagtgtatttcatctgcccagtggctaatgctgtcttctggtggcagagagccagaattcttcctggaataggcctggcttgtggtatgaggctctctgggctttgcccctctgccaggcccactctgcattctatcccttattatctaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggtaagaatctccatggtcgtcgtgcagaaaagtggcaagaatgtggggcatgggtgggtagaccttaccctgaatgtgagttacctaagcatttaaaaatgaaaaggcatgatcatttgggaagttttttagctttagtttcctcgtctataatgtgcactgttcaaatagatctttctcaatttggagaatgcatgtatggtttgaagacagctctgtacccaagatatgtcattcacaggtgttggatattatcacgctaaccctatgaagtcattcctggtattttctcttttcttttcttttcttttttttgagacaaagtctcactctgttgcccaagttggagtgcagtgacacgatctaggctcactgcaacctccaccttctgagttcaagcgattctactgcctcagcctcccgagtagctgggactacaggcacgcgccaccatgcctggctatttttttttgtatttttagtagagatggggtttcaccatgttggccaggctggtctcgaactcctgacctcgtgatccgcctgcctcggactcccaaagtgctgggattacatacgtgagccaccacgcccagcccattcctgggtcatattctaaatgtcggccaagatatatggaggaaccctttctctatcctatgctttaagctaccatttgggcccctacgcctctccatggaagtgatgctgagttgggctgtaggacatgttccatgctggaatggaagcagtgaacttggccagcttgctttgaactttaccatctgatcatagcctggattgggtgtatgggcctgaacttggtgcactggctgcaacatgtgttgttactttcaggtaccgggtctacggtcctcttgttaagttaaacgtgccctaggatctcacatacagctacataaagtaatcttatgaacccccagaaatttactacctcagcatcttttgatcatgcattgtcctttgggagattgatggcattccattcccccaaacaaacaaaaatctcatgtatacggtttacccaaatgagcagagaggtcagtgaataactcggttaatgcaaaactttggtgagcagatagagcaaaggcattgtgaatttcttctgtaccgtcttcgttcctcttgtcattgtttttccctgctcacagatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaagaaaatttcagttcctcctgtgttctagctgaagtcaggttctgcagcctcatcccctaactagctgagtgagaatccagtgggccctctgttttcccttcattggctgatcattcttcagtatgcttgcctgagccgaatctgggcatcaggtactgataagggaaaatcctgggactgtatagaataatgccccctgaaaactgggaaggagctaagagaccaaagaatgacccggacaagtccggcttgataagcagatgaatttcttgggacttacgtatagggcattcctgggtggcagcaggacagctctggggatctgccctgacactcctctgcaagctgcttttaagctaattttctggctctttgccttctgtatgcaatgagactctttctcttggtatgtttcccagtacactctgggatgttttggttctcacagacacctcggctcctaagctgggcaccatgcatggccttagaccaccacctggccttcagggttcaggcagcagacatacagccttaagtaatctggtgggggaggggggaactcattaacctacagtcactagcattattttctccattgaaaaatcatttccttgagggctttgaaaactctttgtgagattatccagagaatgactataagggcttctggaagtcagaaattcactgaattgcagatgaagagaagacatagaactccatttctagcaccacatttccctgtagttttcaaggatacagcaatagcaagagttgcgaactcccgttctagtgtctggtttgaagcagtatgaaaactggggattggttgaaagttgatatggtgaatatcaactttgtgccaacaggcattcagctaaggacaggtctcagcttccaagggatttctttcttttaagtgattctaggggtcaggcttggaatctctgataatgacagtaaaccgaagcaattaggtcagtgagtatcatatcaagttcaccccgatcctatttctacagctgaattaatcttatctggccacatctctaggcttagaacatctccttcttcttgacagaatcgatgtgcgtattcaagcgtggggcagctgccatgctttttcccactcctagtctgggactccaactgccaagttatgaatatcagctgacttggcaacacaaatgatagatgttcttggtccacaaggacttgggcttgttgttagagactgcagaggttcgtcccatcgttcccaggccaactgcagcagacaagcagcaatctagaaaattaggaacaaatttaggtttggatttggactaggtttggattcagaatggacaggggacaatagaaacttacttatgggatagacccaaactggttgaaaaaaatcatgtcctcattatttcggcggatggaaggagctgagtacaatttactcagcccaagaaaaacaacagatgagattggagttccattactccccagggaaccacgtgattgatttccctagagggtggataccagatgggtgacatagctgggtaaacagagtgctacttttactttggctggagatgaggcacacagaaaagctgtggaatggatcattcacgtgttctaatcttgtgactagatagtctcaggacagagaccatggcagatgaatgttttataattaataaataggcagtgagcctggcctagttaaattttctaatgtgattagacaatacgaatacaattttttaaaaaagtattaattttgggagccagattatcttacagacaagtgtgttctgaagtgatccctgtgaagatgacggagtagttgacggatactgactttgggctgcaatgaaactttgctttatactttataattaaaatctgacttgtgttgatttcttggagattttgagtttattgattctcttgtgcttctacgtggaggaaatgggaatcctgatcctaaacaaggaaagatagctcactcaattctgttcaccatttagggatggatggatgcacagttagatagataggtggaacatgcacatggttaaaaatgacatgcagtacagagaaaattcggttttttcgccacccctgtatctcatttatcctacttagaggaaactatatccaggtttttgtgcatacttctaaagatattctgtgcatatgcaagtacatattataattataacaaatatttgtgagtgtgtatgcaccaggcactcttttaagcactctacatatattatttcaattattccttaacaatttatctccagtctacttttccaattctagaacaatgttgtacagaaagctctaactgagggtaagaaccggtgtttgtttgtttgtttatatatttatttatctggtcttctttgagtgagtaagggaaaatcatttcactttcttgggctttgtcttcatctataaaattctatacttgactaaattactgattttcttgttcaattttatagagtcatttttcacaaaacgaaatctttccagaagatcacgaataagagagatcaaagctaggcagcttgagttgaagtagagctggaagaaggagttttgaggactgtttcaaaaccactggactagatgatctctaaaggttcctgtattattttcttcttttcttatggctgttgtaacaaattaccccctgaactttgtggcttaaaataacatgcatgtattctcttatcatcctgattgtcagaagaccaaaatcagtttcagtgggtgaaaatcagggagtcagtagggccaggctccctctggaagctctaagggagaatccattgccttgccatttttagcttctgaagctgtattctttattccttggcaaggcaatggattcttccctggagcttccagagctcccattcctttatcatcgaagccagcatcatagcttcttgtgtcagtcatcacattgcctccttctatgtgaaatgtccctctccttccctcttaataaggaaacgctcttacatttagggccaggcaggataatctccccacctcaagatccttagtcacatttgtaaagtcccttttgccatataaggtggcagtcaggggttccagagactacaacatggatatctttggaggccattatttagcttaccacagcctaccctctaactccccaaaattcatgttcattctacatgcaaaatatatttgcctcacctcaatatccccaaaagtcttaacaccaacgcgagttgaaaatctcatctgtaaatcatctaaaccaggtatgagacagactctgggtatgatccttcttgaggctaaatttcttttcatcagtggccctgcgaactagaaaataaagttacctcttttttattacagtggtgacatggacataggataatggttatagacagtccccctcccaacgggaaaaaatgaaagcaagcaaaaagttaccagctccaagccaacttgaaatccaatcaggtaaactcatttaggtttcaaggcctgggaatattcctccgtggctagaggctctgccctctatgcccgaggctccaccctttaagtgaacagagccaggctctgtcctcagagttatcttgtttttgtttttgttttgaagagtaatacatgtttgcagcagaatactttattattattactattattatactttaagttttagggtacatgtggacaatgtgcaggttagttacacatgcatacatgtgccatgctggtgtgctgcacccattaactcgtcacttagcattaggtatatctcctacagctacccctcccccctttccccaccccacaacagtccccagagtgtgatgttccccttcctgtgtccatgtgttctcattgttcaattcccacctatgagcgagaatatgcggtgtttggttttttgttcttgcgatagtttactgagaatgatgatttccgatttcatccatgtccctacaaaggacatgaactcatccttttttatgactgcatagtattctatggtgtatatgtgccacattttcttaatccagtctatcattgttggacgtttgggttggttccaagtctttgctattgtgaatagtgccgcaataaacatacgtgtgcatgtgtctttatagcagcatgatttataatcttttgggtatatacccagtaatgggatggctgagtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgttttttggctgcataaatgtcttcctttgagaagtgcctgttcatgtccttcgcccactttttgatgggatcgtttgtttttttcttgtaaatttgtttgagttcattgtagattctggatattagccctttgtcagatgagtaggttgcgaaaattttctcccattttgtaggttgcctgttcactctgatggtggtttcttttgctgtgcagaagctctttagtttgattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctgcatagggctagccagttttcccagcaccatttattaaatagggaatcctttccccatttcttgtttttgtcaggtttgtcaaacatcagatggttgtagatatgtggcattatttctgagggctctgtttggttccattcgtctatatcccttttttggtaccggtaccatgctgttttggttactgtagccttgtagtatagtttgaagtcaggtagagtgatgcctccagctttgttcttttggcttaggactgacgtggcaatgcgggctcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagcagtttgtagttctccttgaagaggtccttcacgtcccttgtaagttggattcccaggtattttattctctttgaagcaattgtgaatgggagttcactcatgatttggctctctgtttgtctgttattggtgtataagaatgcttgtgatatttgcacattgattttgtatcctgagactttgctgaagttgcttctcagtttaaggagattttgggctgagacgatggggttttctagatatacaatcatgtcatctgcaaacagggacaatttgacttcctcttttcctaattgaataccctttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcttgaagggttgttgaattttgtcaaaggccttttctgcatctattgagataatcatggggtttttgtctttggctctgtttatatgctggattacgtttattgatttgtgtatgttgaaccagccttgcatcccagggatgaagcccacttgatcatggtggataagctttttgatgtgttgctggattcggtttgccagtattttattgaggatttttgcatcaatgttcatcaaggatattggtctaaaactctcttttttggctgtgtctctgcccggctttggtatcaggatgatgctgtcctcataaaatgaactagggaggattccctctttttctattgattgggatagtttcagaaggaatggtaccagctcctccttctacctctggtagaattcggctgtgaatccatctggtcctggactttttttggttggtaagctattgattactgcctcaatttcagagcctgttattggtctattcagagattcaacttcttcccggtttagtcttgggagggtgtatgtgtcgaggaatttatccatttcttctagatttactagtttatttgtgtagaggtgtttatagtattctctgatggtagtttgtatttctgtgggatcggtggtgatatcccctttgtcattttttattgcttctatttgattcttctctcttttcttctttattagtcttgctagcggtctatcaattttgttgatcctttcaaaaaaacagctcctggattcattgattttttgaagggtttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaattcgcctctacacactgctttgaatgtgtcccagagattctggtatgttgtgtctttgttctcattggtttcaaagaacatctctatttctgccttcatttcgttatgtacccagtagtcattcaggagcaggttgttcagtttccacgtagttgaacggttttgagtgagtttcttaatcctgagttctagtttgattgcactgtggtctgagagacagtttgttagaatttccgttcctttgcgtttgctgaggagtgctttacttccaactgtgtggtcaattttggaataggtgtggtgtggtgctgagaagaatgtatattctgttgatttggggtggagagttctgtagatgtctgttaggtccacttggtgcagagctgaattcagttcctggatatccttgtgaactttctgtcttgttgatctgtctaatgttgacagtggggtgttaaagtctcccattattattgtgtgggagtctaattctctttgtaggtcactcaggacttgctttatgaatctgggtgctcctgtattgggtgcatatatatttaggatagttagttcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctatatccagtttgccagtctgtgccttttagttggagcatttagcccatttacgtttaaggttagtattgttatgtgtgaatgtgatcctgtcattatgatgttagctggttattttgctcgtcagttgatgcagtttcttcctagcctggatggtctttacaatttggcatgtttttgcagtggctggtaccggttgttcctttccatgtttagtgcttccttcaggagctcttttagggcaggcctggtgctcacaaaatctctcagcatttggttgtctgtaaagtattttatttctccttcacttatgaagcttagtttggctggatatgacattctgggttgaaaattcttttctttaagaatgttgaatattggctcccactctcttctggcttgtagagtttctgccgggagatccgctgttagtctgatgggcttccctttgtgggtaacccgacctttctctctggctgcccttaacattttttccttcatttcaacgttggtgaatctgacaattatgtgtcttggagttgctcttctctaggaatatctttgtggcattctctgtatttcctgaatttgaatgttggtctgccttgctagattggggaagttctcctggataagtcctgcagagtgttttccaacttgtttccattctccccgtcactttcaggtgcaccaatcagatgtagatttggtcttttcacatagtcccatgtttcttggaggctttgttcgtttcttttttttcttttttctctaaacttctcttcacgcttcatatgattcatttcatcttccattgctgataccctttcttccagttgattgcatcggttactgagccttgtgcattcgttacgtagttctcgtgccatggttttcagctccatcaggtcctttaaggacttctctgcattgattattctagttatccattcgtctaattttttttcaaagtttctaacttctttgccagtggtttgaacttcctcctgcagctcggagtagtttgatcatctgaagccttcctctctcaactcatcaaagtcattctccgtccagctttgttctgttgctggtgaggagctgcgttcctttggaggaggagaggcactctgatttttcgagtttccagtttttctgctctgttttttccccatctttgtggttttatctacctttggtctttgatgatggtgacgtacagatgggtttttggtgtggatgtcctttctgtttgttagttttccttctaacagccaggaccctcagctgcaggtgtgttggagtctactggaggtccactccaaaccctgtttgcctgggtatcagcagcagtggctgcagaacagcagatattggtgaactgcagatgctgctgcctgatcgtacctctggaagttttgtgtcagaggagtacctggccgtgtgaggtgtcagtccgccccgactggggggtgcctcccagttaggctactcgggggtcagggacccacttgaggaggcagtctgcctgttctcaggtctccagctgcgtgccgggagaaccactactctcttcaaagctgtcagacggggacatttaagactgcagaagttattgctgtcttttgtttgtctgtgccctgcccccagaggtggagcctacagaggcaggcaggcctcctggagctctggtgggctccccccaagtcgagcttcctggccgctttgtttacctactcaagcctgagcaatggcgggcacccctcccccagcctcgctgccgccttgcagtttgatctcagactgctgtgctagcaatgagtgaggctccgtgggcataggaccctctgagccaggtgcgggatataatctcctggtgtgctgtttgtgaagcctgttggaaaagtgcagtattagggtgggagtgaccctattttccaggtgccctctgtcacccctttctttgactaggaaagggaattccctgaccccttgcacttcccgggtgaggcgatgcctctccctgctttggctcatgcacggtgcactgcacccactgtcctgcacccactgtccgacactcccctgtgagatgaacccggtacctcagttggaaatgcagaaatcacccgccttctgcgtcgctcacgctgggaggtgtagactggagctgttcctattcggccatcttggctccacccagtttttaatatttaacttcaccactgagtcagaactgaaacagttggtacggaggcctgtgttagtgagactttggcttgccacaaaaccaccctaattgaagaaatgaaaatctgatgtccaagtaagtaatgaagccaatttgaataaagttatttatgtgattgcaaattttaaaaagaacctacgaacgaatacttaaaaaaaaatttaaggtagtgctgtgctttgaatatgtccttcaaagttcatgtgttggatactcaattgctgttgtaacaatgttgagagttaggacctttcagaacagattaggtcatgagggctctgcctcatgaatggattaatgctgttattgtgagactgtgttagttatcatggcagtgggctcctgataaaaggctaagtccaaaccccattttctctttgtctcacacactctatcaccatgtgacaccttcaatgtaccctgccagatactggtgccatgctcttgagacttcccagccgccagaacagtgagccaaataaaattgtcttctttataaattgcctagcctgtgcattctgttatagcagtagaaaacagactatggcaggtaggtagacatattacccaaagagaaacacatctgaaaaatatacaccaatctttttacattgaatatgtatgcatcacagtgatgggatcatatagatggaagatgtagaatgatttcatcttctaaatatacatttataatgtttagtattttttaattaggaaaatttcttgagagaaacacttgaaaatatgtaacagcaaattaacaagaaaacacataaatatttttattttaagaagcgttcatgctatgctgtttttttttaaaagaaagattataataactcttgacttgagagttacccctatctgtgtaggtgtgtgatttgtatattacagttccatcatttagaatgttcaaactctcaatgtgcagacttatcttctgctctctcaggggttggatgtcctctctcagggcatagagacacaataagggattgctgttaagggatggacaattatagaaatttctggttgatgcactgcatatcagtcccttttatcactcccttccccttgcaagctgatctgtcctgagacttttggggttataagtctgactctgacaaacaaatagcatctttgtacattcaatactttaaaaggaaaaggtgtgattctttttttctactcccattccagtggccactaaattatctttcctatttcctttatactttccatgtctgtctctaatatgccctctctgagatggactgcactttttttttctgtcattcagttattttcagatatttttgataactttgtccttccttaagaatatgtgatgcgcaagagtttattaaaactatgtgtggtgaaatcatgcccatccagtagagctcagttctaatgctggcaatttcatgtagcatctgaatgaaccctgacaagcttctacaactcattaagtctcagcaacctaagacaggccaagaagctggtaattctgcctaccagaatcccgttatgaggaacacatggaggaagaaaatgtaatgtaatgcagcaagcacagagcatggcatgcagcaggccctcagagttcccccatgtccgtagctacgagtacctgggttccgggtctcccgactatagttagcttgctctgcaggggtgactcaattggaaacagctccctgggtgttggtggcaaactcagggggcactaagaacaggaagtagagtctcttctggctcccagggctctcctcactatgcccttcgggaaaggacttattttgaaaactccaccttgctcacgtgagcctgacaaaatggtctgaggcctactcttgcctcgtttgacagatcccctcaattttctctgaaccccagctccagatctcacagattctcctcacaaacaccatgtgaagacagtggtgacaggtcactacccacatgccacaccatgggtgaattggtcagtgccaatccttggcctcaggatctcacagggcatgaagggttctgggccccctctcccactccaacccccaggacacccagcagactcactttcagttagagctggtaggtggcaagggcccaggctgagtgttttccattgtcctgaggatgagggcaaagtgaaccctgagatacctgtcttagtccattttgtgctgttataagagaacactcaacactgggtgtgttagtctgttctcacactgctgtaaaaatactgcctgagactcggtaatttataaacagaaaaggttcaattgactcacagttccacatggctggggagggctcaggaaacttacaatcatgggagaaggcgaaggggaagcaaggcttgtctttcatgatggcaggcgagagagagagcgaggaagcgccacactttaaaaccatcagctctcgcgggaactccatcactatcgtgagaacagcacggggaaaaccgcccccatgatccagtcacctcccaccaggtccctccctccacacgtgaggattacaattcaacatgagacttgggtggggacacagagccaaactgtatcactgggtggtttataaagaacagcaatttgtatcttacagttctggaggctgggaagtgcaaggtgggggggcttgcatctgatgagagccttcttgctgtgtcatccaatggcagaaggtgggagggctagagtgcacaagagagagaaagcaagagatcaaactcatagactcaagcccttttataattggtattaatccattcctcaaggtgcaaccctcatatgacctaaacacctcccattaggagggagggttgcactggggattaagtttccaacacatgcttttttggggacacattcaaaccaaccattgcatcctgcccctggccccccaaatttatgtccttctcacatgcaaaatacattaattccatcccagtagccccaaagtcttaactcactccagcacccaaagtccagagtctcatctaaattagagatgggtgagactcaaggcaggatccagactgaggaaaatttcctctagctctgagtctgtgaaatcaaaacaagttgtctattcccaaaatacagtggcgggacaggcgtaggatagacattctcattccaagagggagagacaggcaacagaaaaggcataactgatcctaagaaagtccaaaacccatcagagcaaacaacattaaattttgaggcttgagaataatgttcaagttctgccttctgaggcagggattgggcccccagattctcaggcagccatgcctctatggctttgctaggctcagtccacccagcagctctcacaggttggagtcttgttcctccagctctcccagggtatcattaaatgccagtagctctgaaattctggaatcttagtagcagtccagctcccacacctctactagacattacccgaattgggactctctgcaactgacttgttcccacagccccatcaggtactggcctgatggggactctctctggcagctctgcccctgtggcaggtctctacatgggtcctcaggctgtctgcaacattctgcgaaatctaggtggaggccgtcacagacccatagctcgtgaatgctgtgcacctgcagaatcagcaccatttggatgccgccaaggtccaccgcttgagccttccagaccggcagcctgttcagcacccggccccccttgaactatggctgggacagccgaggagtgctgcacgaaggtgcgggcagcagacacttaaaagcatcacggggcagcagatgttgaggtcccgtgggcgtctctctggaaactttgccttcgcattgtgcactgggcatgtgactggaggagcagcctggaaaactctgaaatgccgtcagggcctttctccagtggtctttgtcttactgaatagcacctgtttcccttctagccatggtaatctcattagcaaagtggtcacttggccatgtctgtagtttgcactcctaaacacgctttttcattctttacatggctagggtgaaatttttcaacatatttaccttcttcctatcttttaattgacaaattccatctttaaagcatttctctcttctctcatttttgtctaagtggccgaacaaagtcacgcagtaccttgaatgttttgctgtttagttatttttactgccagatatcctagttcattaccctgaagttcttttaatttttttcatttttccatttttgtgggtacatagtaggtgtatatatttatggggtatatgagatatgttggaacaggcatgcggtgtgtactaatcacatcacatcccctcaagcatttgtcatgtgtgttacaaacaatctgtatcctcttaggtactttaaaatgtacaattcaactattactgactttaggcaacatgctgtgatatcccaccttattcattctttctgtatttttttgcatccattaaccatccccacctaccccctgcctccacactacccttcccagcctctggtaaccatccttctactctctatgtccacgagatcaatcgttttgattctcaggtcctacaaatcagtgagaacatgcgatgtttgtctatctgtgcctggcttatttcactcaacataaagatctccaattctatccacgttgttgcagatgactggatctcattctttttacgactgaatagtactccattgggtatatgtagcacattttctttatccactcatctgttgatggacacttaggttgcttccacatgttgctattgtaaacagtgctgcaacaaacaggagtgcagatatctcttccatatgctgatttcctttcttttgggtatatacttggcagttggattggtggatcatgtggtagctcaaattttagttttctgaggaacctgcagagtgttctccataatcgttgtactaatttcattcccaccaacagtgtacgagggttcccttttctccacaccctcatcagcatttgttattgcctgtcttttggatataagccattttaactggggtgagaagatatctcattgtggctctaaagatcagtgatattgagcacctcttcatctgcctgtttgccatttgtacgtcttcttttgagaaatgtgtattcaaatcttttgcccattctctaaccggattattagattttctccaatagagttgtttgagctccttgtatattttactggttattaatcccttctcagatgggtagcttgcaaatattttttcccattttgtgggttgtgtcttcactttagtggttgtttcctttgctgtgcagaagctttttaactagtcatgcatgatcccatttgtccatttttgctttggatgccagtgcttctcgggtattactcgagaaatttttgcccagaacagtatcctggagcgtttccccggtgttttcttgtagaagtttcataggctgacatctcagatttacgtctttaatccattctgatttgatttttatataagatgagagataagggtcaagtttcattcttctccatagggatacccagttttcccagcaccagcgccatttattgaagagactgtcctttttccagtgtatgttcttggcacctttgtcaaaaatgagttcactgtaggtgtgtggatttgttcctgggttgcctattctgtcccattggtctatgggtctgttttaatgtcagtaccttgctgatttggttactatagctctgtagtataatttgaagtcaggtaatgtgattcctccagtgttgttcgtttttgctcaggatagctttggctattctgggccttttgtggtactatatgcattttaggattgcttttcctatttctgtaaagaatgtcactggtgtttttgtagggattgcatcaaatctgtggattgctttgggtatgatggacatttaaacaatattgattcttccaacgcatgaacatggaataactttccattattgtgtcctcttcgatttatttcatgaatgtcttccagttttcattgtggagatctttcacttctttggttaattccgaggtatttaattttatttgtgtctactgtaagtgagattaattttgatttctttttcagggtgttcactattggcatatataaatgctagtgatttttgtaggttgattttgtatcctgcaactttactaaattggttgatcagttctaatagttttctggtggagtcttaaggtttttctaaatataagatcgtatcatcagcaaacaaaggtaatttggcttcttcctttccagtgtggatgctctttacttctttctcttacctgattgcttgagcaaagacttcccgtactatgttgaataacagtggtgaatgtgggcatccttgtcatgttccagatcttagaggaaaggctttcactttttccccattcagtatgatactagctgtcagtctgttgtatatgacttttattatgttgaggtatgttccttccatacccagtttgttgaggaattttatcaggaaggaatgttggatttttatcaaatgctttttcagcatcagttgaaataatcatatggtttttatctttcattctgttgatgtgatgtgtcacattgattgagttgcatatgttgaaccatcctcgcatcccagggataaatcccacttggtcatgatgaacgatctttctgatgtattgttgagttgggtttgctagtatttagtggaggatttttgcatcgatattcatcagagatattggcctgtattaagaagtcactgtaagaagatgcctgagagtggatacttggtcagtgtaatgattttaatatgcgccttttctattcttcagaaaatagtctcctttcttatttactttagaatgtcatgacccccaacctatggaattaattaaacaagaaacatttccaatacactatttcacattcagaaggtttcacagtctttcagtgtcaaaccttgtgagcaaagccagggcaacaggctctaagctgacaaaaaagtttaccagtatcttccatagagatggccttttcattcatatagattccatcggcaagtcaggccagacctttcagactctgacttgtaaaaaagtcttgtgtaaggaaaacttaccagtttgcaactagtgtttggtcactgctgagagaaacaaatattaaaaaataaataaatatgtctcagagagttaaataggcatacttggaaacacgaaagcttggaaaatgaatttaatatggcagattttattgagaatgcatcatgagtcataggagttcagaaatcaggaagttcaggaagaagaaaaagatcacaaaggcaagtttatgattacacctactaatcgaggaactgcttgctctgcaaccagtagatgatcacgagatggtcagatcttggtaggcccacaagagatgtcaaaataaaattctcaaaaataaacatcctagagacctccagttctggccaagctggagtttgccctttcctcccagatggtccctctacatcagaacaccctgaatataacagcaaaccagcaaagaaagctctgaaacgtggaaaggggaaagcagaccgactcatgctctcaggactcgagcaagaacacaggcagcgcattcccttggtttttctatttccacccaatatcccagacagggcaccgcagaagcccccagtccagaaccaccaacaatggcagacacaaagctccaagaaaagcctatttcctctgccaaaagaccataaaaaacgtgatctaaaaactgaaaaacctttgtgacaaattcccctcccctacactagacaaacaacaatggaaaaaccttatctcccccaccccccaaggtttcagggaacaagaaggaaacttgtcttctatcctgcctctctgaggcagatggtgatgatccaattcacctgtcagggtagtgtcagtggtgtccagcagcaagatgagccttcaccttcacctgacatcaataacactgaacaaggcagtccaagttgggactagtaagcattccatttatccccatctctggtgtcagtgatgcccagtggaaagttgaacctttacactcatccaaactcaatgaagtggtgtgaggcggggctaatcgacactctgctttcccgctcaggcattctgtgcaagctaggccctatggagagctgtgcctcctcatccacccatcatcaagatggaatcaggtggtgggaggcagggtttgttggcagtctcctttccccctccttcccctgatgttctcagagaccagtggggacctaggcttctgccccaccacactgcagcaacaaaactttgagtcagccatccagttcccctttccctaaagcctagcaaagaactgtgcctatactccccgaccccacctctgaggtaacaaagtgtggtgaattggtgcccccttttttattggaaatgttctcaggggggctagggtagaagttcagctcccacccccagccatctgtgaagaggcaaggtgaaccagcaatctagtttgctaggatggtatcagaacaggaatctgcacttatcaccttatgatatgatgggaccaccatcatatatgtggtctatcattgaacaaaaagtcattatgtggtgcatgactgaatatggactatcttaatgaaatgtcatcacagccttatgaggttaaattttttactattcccagtttaaagatggataataaaagcttggaagagtttacctggccaaggttatttagctacaaagtggtaatgccacggattcaatcctaagatacctgatgcccattaccccatctactgaaagatgacactgtactgcaaaaattaaaacagacatagctgatctgcttctttacctgtaattagagtaaaagaaaacaacaaaagaaaacaaaaacaacacagtgacatgctaactgtcatgaagaaaagtaccacatgtctgataaggtgatcagagatgtacactaagtaaggaaggtagctatagggatatctaaagccaggctgttacagaaaaacactcaacggtatgggagtatgcttgctgagctagtgttagagcaacaaaaaggaggctagtgtggctggagaaaaatccatttattcattcaaagtatccactgaagcaggcattgttataggcacttagggtacattaatgagcaatagacaaagatatttgcccttctggaatttttatttttccaccatgggagacagacaataaaaaacaaaaacagcatatgattaaaatatattgcattccagaagatgactgcgggggggaaaaatcaaatagggaagaagtggaatcaggagtgtgggctgagggttggacattcaaacaaatattggctgctttgcaattgatagtattattagatgggtggaagtcttctcctttgtgccgcctttgccaggcatcagtgtaaatgctctgttggcttcactgcagaggacaacacatttttcctatctttggtcaggactcagttccttctttaatatatcagagaaccagagacactaatatctgacagccttttgccatcaagtggccatgcgttttttaagtaagcatcccctgctacacgtccactaaatttgagcttttaactgtctgtgttgagacgtggcctggtagaaaccctcgctggggccaggcgcggtggctcacgcctgtaatcccagcactttgtgaggccgagtcgggcggattacgaggtcaagagagggacaccatcctggctaacatggtaaaaccccgtctccactgaaaatagaaaaaccagccgggcgtggtggcaggtgcctgtaatgccagctactcgggaggctgaggtaggagaattgcttgaacccgggaggcagaggttgcatgagatgggatcccgccagtgcactccagcctgggcaacagagcgagacgccgtctcaaaaaaaaaaaaaaaaaaaaaaaaaaaaagaaaagaaaagaaaagaaaaaaaaagaaagaaagaaagcaaagaaaccctggctggccagtgcccaggccatacacaatggcattgtgcctcacttttcacctaagacgaaatcagcgggtggggcaggcttataatcagaacacccctccctttccacctcacacactcccacccgcctgtcccacaatccttcctgcccctcccgctctcccacccttggtttctcgaaaccccttctccttccctgccccccgtcccccgagccccaggagggggaggggcaggaatctggctccgcctcccagtatggagatgattggtcaaaggaggtcacctgaccaagctgagccaattgaagtcctctccccactgctttgagaaggaaccgttaagacgctgggccccacccacaagattgcgtcttgtttgtggcaagattctgaggggaagtgtagctcccaggttggttccaagtcttcttccaattaggtaaattacaacaatatcttttccataaatttcctttcttttcttttttgcctttttttttttttttttttttttttgagacggagtttggctcttgttgcccaggctggggcgtaatgtcgcgatctcggctcaccacaacccccacctcccgggttcaagcgattctcctgcctcactcccaagtacctgggattacaggcatgcgccatcatgccaggctaatttttgtatttttagtagagagggggtttctccatattggttaggctggtctccaactcccgacctcaggggatccaccgcctcggccttccaaagtgctgggattacaggcgtgagcgtccgtgcccggcccttctataaattttatataaactaggccttttttggcctacattacctagggtcaaggtttagggattcataggaaaggcaaatccggctggattgctcagtggtccactctccagtccactctctatgtatcccttatcttcacgtgtgattaggttcaattgtatggctaatcacttcatgttctctctttgcaatttctcaggcaggttttctcttcttcttcagaaagttatatttctcttttgcatcttagttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagccactgattttgtcttttaaaattctttactctgaaataattttagacttacagaaaagttacaaaaatgattatacagagagccctcgcctggatttccttaatgttaacatcttatataaccatagaaaaattaccaaaactaactactacattacattgatgcactaattgacattactacatcgatgttaattaccaacagttagcattgatgtagtactattaactaatctacagattttatgtgaatttcaccagatatctcactgatgtcctttttctattctaggatcttatccaggacgcttcattgcatttggtcttcatttctccttagtctcctccaggctgacatttcctcaatctttattggtcttccacagccctgacacttttggagataccagtcaggtattttgtggaatgtctctcaatttgtgtttgtctcatgttttcttatgattagattgaagttgtgcatttgtagcaagcacacctgttttattctcctccctttcccagtggcgagggagggattcccaccctagtgttatgggggcggctgaacacatggtaccctatactggacagacggaatccacagcaatttatcagtaacatttactcacaactggagagaggagggcacctcacgccaggtagagccacacagtgtcacactctggaagagagtgaacaagcaggggctttcagggggaagtctttgtagtaaccagaggatgaagtgaccgttggttcagggtaggacgattggcttgtttgaataattctgcaggctggtggggacctgaaacatgctacccagagataagcaggcactgtgtctgttcaacatgataataaggagggtactttggccagggggcctttctccctgggaacccaatagggaagataacttgtggtgaggccattcagggtcctcctgttctaccccagatgtcaaggcatccatataattggacctctaattttaggtcttatgcgacattaccgcaaacgtgatttcgttcccttctatgtggatcatgtcaggggtacatgacatccataagttgtattactggtggtgctcaccttgatcacttggttaaagtggtgggagttatgctgccccagtgtaatgctactattttcctctttgttagtaataaatatagtgtgaaaagttctttaagaagaaacacaatagatcctcttatattcctgtttcttcgcagactttgacccactactgttaaaatctgtctagggatcttgcctacagcaaatattacctaatggtgattttctgttttcctaatttctgctacatttattaattggaattcctctgtaaggaagagctatctttactccctcattcatttatttcttcaatttatttatctcagtatgggctcttgaataattatgttatacatgccaggcttaatacctaggtgatgggttgatgggtgcagcaaaccaccagggcgcaggtttacctatgtaatgaacctgcacatcctgcgcatgtatcctggaacttgcaataaaataaaataaaaatttaatctaattatatcattattttgttctttgaactgttctagccttggccattgggaagtcattttggttggttctgtggtcttttgatatgaccctatccttttttggtacctttttctggcacaataagatgttcagattcagcatgtgtgtgcccccctcccctcacacacacacaccccttatagccctggattaaaacaacttctacgaggagccccggttccctttcttggggaatgatatttaccaaccagtatctcggtgtgtgttcattattaatggcgtttcattgctgctaaggctctctctatggagagggttaggaaataatgtatgtatacacccatgcctatagacacatccacatttattttggtatctatctgtatgcatagctattaaaagccaggagcttgtattgatactttcaattccaatcattctagacttatttgtagattcgttctccgacctggctttcattatcaaatagtttacatacctgtttatttctggtcagtagatacataaagtagcgcctgaattgctaacaaatgcccctgttgcaaacatattaataacttatatttttgtacagttgtttttgtctttggccttagaggatatagtcaaaatactgctctccaaagttatgtatcttagatcttttcttcctctctccttcagcgtggttaagacactcatttgtaatattgttagttgaacctgtttctgtttgatttggggtaccctcaccccaatatcccggttgattttaattttttatttatattttgggtatgtgcatcattactatgatccaaagagtcagggttatacaaaaacctatactcggagaaatgtcactccttcgtcatcccttctaccctgttcccattccccatttctttccacttctttccctggccctccctgtagggtaatcagcccctttggtttctggtttaacctttcctgtatttattttgcccaaatgagcagatacatacatgttttctcatattcctttcttacacgaaggatagcatactatacatgttcctttgcactttgcctttcctacttaacagcattcttggaaatcactccatattgtttcacagagatcttcatcgttcgtttttacagctgcattgtactccattgtgtggctgcgccacacatagtttattcaaccactcgcctatgtttgggcattttgtttttaatacagaaaccaggtctcgctctataacccaggctgactgaagtgcagtggcacaatcatagctcatggtaacctcaaactcctgggctcaagcaattcacaactgcctcagcctcccaagtggctaggactacaggtgtgtgccaccatgcctggctaattaaagactttttattttttattttattttttgtcgatatggggcctcgctatgttgcccagactggtctggatctcctggcctccagtgatcctcccgccttggtctccaaagtgctgagattacaggcatgagccatggtgcctggcctgtatgggcttttaaattccttccaagattttgcagttacagacattactcccgcgaataaccctggacatgattttttttttttttttgtattggtagaaatgtaccttcaaggtatattcccactggtaggattattgggccaaaagttaagtgcacatgtagttttcttaggtgtttccaagtttctctccagaaggattgtactggttttcatttccattagcaatatatgagaatgacaatttccccacagcctcactaacagaacatgttgccttacttttgaaacttttttctacgggttaggcgagaaatggtgtctcgctgtttctgtaatatacctttgtctaactatgagcaagttttgacacttaaccatatatttgaggactgtttttatactttttgttggaattatctgttcatatctttcccccatatttctattgctgttgtggtccttcatccctcaatatttaagagctctctatatatttggaatattatccagttgtctgcgatatgtgctgcaagtactttacatcaatttgtcagttgccttttgatttatttatgatgcatttgcatcactttcgtttatccttatgtggtcaaatggattgattatttttttctttcattgcctccggaatttgaatcctagttagaaagcttttccctacagtggggttctgccatgttttgttttgttttgttttgttttttctttcttttctttggttgacatggagtctcgctttgtcgtccaggctggagtgcagtggcgcgatctcggctcactgcaacctctgcctcccaggttcaagcaattctcctgtctcagcctctcgagtagctgggattacagccgcccgccacctcgcctggctcattttcgtatttttagtagagacggggtttcaccattttggccaggctggtctcaaactccggacctcaggcgatccacccgcttcagcctcccaaagtgctgggattataggcgtgagccacccccctcccccggccactgccatgttttcttcaagaacttacatggtttcatttgttatgtttagatccctaacccatttgcagtttattcttgtgcatgctgtgttatatggatctacctttatttttccagacgtctcagttgttccaggaccatttattaaatgtccatctttgccctaaagagtttatgtgccatctttatcatgtactaactgtcatatgatttggttgtatttctgagttttctattctagtccactgggctattagtctattcttgcaccagtgccacaatgtcgtaattacagaggctttatagtgtgcttttctggctgatatcataagtcccctctcatagattttctttttcacgtgtttcctggctatgcttgcatgttttcacaaatatattaactttattatcaatttgcctaaatgcataaaaatgtgtgctggcgtttttgcgactgaattaaatttatacaccaatttaggaagaaccgacatctttttaatgctggattattccatctaggacagtgacgtagtctgtttgggctgctattacaaaataccatagactaggtagtttataaacaacagaaatttatttctcgcagctctggagactgacaagtccaagataaagattctggctgatttggtgtctggtgaggaccctcttcctcatcgatggtactttctaattgtatcctcaacatggtggaagggacaaggcagctctctgaagcctcttttatgagagaactaatcccattcataagggctccacccttatgacctagtcgcctctcaaaaggccccacctcctaatggcatcaccttgcgggtaaaatttcctaacctgcacattgtgcacatgtaccctaaaacttgaagtgtaataataataaaataaaataaaataaaaataaaaataaaaaatttcaagatagtaattttgggggtacacaaacattcagaccatctcagatagcgtatgtgtttccatttgttcaagtcttctgtggtgtcattcaggcatatttaaaaatttttcttgtataaatgttgttatcaagtttattcctaaactttaatccttgttgctagtgtatatggggctttgtctgtgaatgtatcctccagctgcttattttttgtgtgtgtattaaaagactgctgattttttgtatgttaattttatattttgctaccttaatgacttcttttactggttcagttgatttatcatcgtttctatagggtttttcaggtatactataatatcatctgcatgtagagatggctttacttctctttgtaaaaagtaagttttattgtgtatatctaaggtatacaacacggtgttatgggacacgtatggatagtaaaatagttactatagtggaacaaattaacataacccattatgtcacatagtgacccatttttggttttggtagcagtaggcgctaaaatctattcatttagcagaaatcccgcatcatacttaatagtacaattgtacaaactgtattccagcatgttgtgcactagatctctagtctctttcatcctacatatctgctactttgcatcctctgacctacatctcccgctttcctcctcccatcccctcctccccaccccgaccctgataaccactgctttattctgtatctctgtatatttgagttttgttttacttttatttttttaagattccacatataagtgagatcatgcaatatttctctttctgtatctggattatttcactattatttcattgttatagcataatgtcctccagattcatccatgttttggcaaatggcaagatctcctttttaaagtgtatacatacaacacattttctgtatccatctgtcccttgatggacacctaggttgtttccatatcttggctattgtgattaatgctgcagtgaacatgggagttcagatacttttcaaagatcagctactttcaaaaggtggttattttatttcctttaagtagatacccagaaaagcagttgctgggtcatatgatagttctctttttcactaccatatttttttctaaaatagaaaaatgtagaactaccattttatttactaaaacagaaaaaaaaaatctatttctttaggtacctccatactgttttccataatgattgtccctatctacattcccatcaacagtgtacaagggttcccttttctccacacactcggcaatgtttgccatctcttggctttttgataatagctatcctaatggttgtatggtgttgcctcatagtagcttttatctgcattttcctgatgattaatgatgttgagcactttttcatacacctgttagtcagtgtgtatgtcttctttggagaaatgtctattcaggtcctttgcccgttgtttaaatttgattgtttttctgctatggagttgtatgatttccttacaaaatttggatgctaaccccttattcatatatatgttttgcaagtatttgctctcaatgtgtaagttgccatttcattttgttgattgttccctttgctgtgctttttagttcttcttattcattcctaggaaaatgatctatttctctgctcagttgactaatacttgtaatgcaagattgaataggtgtgaggtagtaggcatgctttccttgttcctgatcccaagggaaagcttcgagtgcccccccaccccattaaataagttactagcattaggacttaggtatatatgttttatcatgttaagaaagcatcctgtggtgcctattttcttaaggcttttctattttttaacataaagaggtgttgaatttttccaaaggctttttcaacatctgtggtgataaccatatgatatttgtctttaagtatattaatatggtggatgatatcaaggtactttctaatattgagccaatctgtattgatgggataaatcccactttgccaaagtatattatgattttttaaatatgttgtttgctaatattttatctagcatttttgcatctacacttatctatccatgtcacacttgcttcataaaggaagttatgaaaatttcctttataatgctgttgaataatttatagagcattggcactctggtactatctgatctttgaaggtttagtagaattgacctgtaatagcatctgagccaggtgcttcttgggagttattccttaataactttttccatttttttctgtaaaaattggccaagttaagccttccagcattagagtaaaaatcttgataatctgtattttcctaggaaattatttatttcatgtgtatttttaatttctttatacacaggtttgaaaagcaacctaattttttctgtttaaatgattatcatttgtcgtttattattttgtatatttgtgctctctccctttcttccttcattaatctgcctagtgagtttgtccattaaaaaaaaaaccaggattttgatttaataaatatacacacattgtttttctactatgtatcttattaacatctgcttatgtattcattcattcattcattcattcattcattttaatgaccgaatctccctggatcactcagtctggagtgcagcgttgtgatcacagctcactgcagccttgagctcctgggctcaagcaatcttcccacctccgcctcctcagtaagtaggactacaggcatgttccatcacgccctgctaaagaatcattattattattattattactgtagaggcagggtctccttatgttgcccaggctggtctcaaacgcctggcctcaagtgatcctcccgcctcagcctctcaaagtggttggattacaggtgtgagccaccaagcccggcaatttctgcttttatgttatttctttatttgtgtttcttttggtttcccgggttgttcttttattagatttttgaggcagtgctttaatttgtctaattttattcgttcattttcattgatgagagtatttagcgctctgaatctgcttccaatcactgctttaactatcttctacagagtctcatatgtaagctcttataatcactcttcttaaatatttctgtaacttcagttggtatctcgtctttatctcgacatttgcttaatagaagactgaacattttttccaggtagaagagcctttgtgctttcagtttgtgttagtaagttctacttttgttgcatcgtgattgcagagggttggttgtaatatttctactttatggaaattagcgaggccttcactgtgaggtaattatgatcacgttttgttaacgtgccatcagcttttgacaaggtggtatattctttatctccaaggtgtagatttatgtgtgtgtatgtatgcctatgtgtgtatacacacacacaatgtatcttattgtgttgtttacattttcggtataggtctctttattgtaccactggatttgccttgtactgagacttgccatgtattaaatctcctattattactgtgcttcaatgtctccataccttttggcattacaaaggtggttcctatgttatttggtgcataagtattcctaagtattatatattcactgtgaattttcaattttaatgttagcatgtaaactttgtcattaaaaaaattacttttagcacctgctttcttattgaacattttactatctggtccactagtttgtttttaacccccagtctccttttaacactcatctactgccttatgaaaaaaaaaaagtttattctctttttctttctatctctctcacttctcttattttacttgcactatttctttttttccacaatataaaataaatgcacgttagtcattttccttgcttcaccttcattttagtattagataccaaatgcttgccatcagatgttgtagggaagattttcctgtcgttacctgtggaatcacaatcccagtttaccctttagaatataagttagcaaacgttttctgtaaagagccatatggtaaatattccaaccagtgggccatagtttgcagacccttgctctagtggagtcctcaggaagggctgatgggtacataatttcctaagttcctgtctgtttttctataagctgtgatattagtgaaggatcggctgagctggatatcaaatcagtacttcagacgtttttctcagcccatttctgagtttagagttttaagtaatattctaattcaaggcaggttttatatcctcaaatgcttgtttgaatggaattaattctgtttgcagggttgacgtacagttccttctgtttcatggttgtttaatatgtgtgaaatttgtcttctgctctttttctctttctggaatgtttttgtaaggaattatccttccttttgttcatttttatgatattggattgttttaccagattcctattttacaggtgctattttctgtcagtgtagaaaaattcaggcctgaaatttactgatttcgtttgcttgttttggtagcggacaaagaagttatgagtgctctgattctgtggttctcttatgtcttgcaagattcttcattttccccttttgtttcttttccccatcattaccaaagtggcaaagcatgcttctccctttctgtttgcccttactcttacccagaagctgtggatttcaaaggctacttttattttattttattttaatttgagatagagtctcgctctgtctcccaggctggagtgcaggggtgtgatctcggctcactgcaacttctgcctcctgggctccagcgatcctcccacctcagcctcccgagtagctgggaccacaggcgcacaccaccacacttggccactgttttaagttttcgtagagacgaggtctcactatattgcctaggctggtctgaaactcctgggctcagtggtcctcctgcctcgggcctcccaaagtgatgggattacaggcatgagccactgcacccaacccaaagactacattctaagatcatctctacccctttaaattacacgtattttagaggtccttccctgtagtccctgctcttattatctgggacacctttttggtatttttttagacttagtctgggctcagtcattttaactgtagtttcggaccaactttaagtcccttgcctcttcctttctctgtgtctcttgcagcttttcttggtctgtctttgcttgccacaaagactagtgatgagagcatgacagatcttgtgctgggatttcatgccttttctccttttactcactactaaagatttggcattatctgtttctaagtaacgatgaggatgtggcttctgtatagatttacatcttcctttctgattggtttatatccttttgacatgaaacattgggaggcaggtgcctgggtggtcgacattgccttatgctgacttacagctgatttcaaatggcattttatcttatctaaatacatatgtgtgtgtatacacacacagacagacagacaccacacacacacacacacacacacacacacacacacacaccaacacagacatttatacacacatacaagtctatttgtattccatgtctatagtagaggtctcttgaagtggtcgtttgatttaccatatatttgttcaatacatatttcatttattgctatctttggtggcaggcaagagactgtgaaaatcttctcaggatttgttaatgttcctcaccctaaagcaggttcatgtcaatggaccaaaaggtgccagccacactgctagagctcgctgcatggagtctgctgagtgatgagcctgcagctatccatgctcttgaggagctcccatgagacctctttgttccattgttcatcactgccttcttgggtgggcagaagatgaaactaaaggccatggtgaggatttggccctcccgttgtctccatgttggaccgttgagtgtaagggagtcacactatgaaatcttgggagccacgattgatggtcctgcagatcctccctgcccagagctcttcccctcggtaaccctatgtacactagagacatagtgagtcatcaggagggtatgctgcagcctgaggcagggggtggcctaacagtctcccaaaggtggttgacggtgaatgctgaggatctctgtgaggttgttggtccaacacttggggtcaccttaaggactctaatgtcttacagaggtgattatggaatagaggtgattgagagtactattgatggattcacctactgggtatgattacatagaagaacaacatggacaccagactggggaggatcggaggagaaggaaggatgggaaaaacaataaaagatgttgagtttgtacaaaaaaatatttgttggtagattgtttacagagtgaagagcaaagataaagggtttgcccctccttcccctcattgatgttgctgggttatattaaaatcagccacctttcatattctgtctcttcctcttcctgcagacggccaaaacggagggtcctggatttaaagcaggacccagacagcagaaccacatgctctgagatcaggagcacattcccattttgttttcagtcttgcgtttactctcagcactctatcctgaaaatagaagaagccaagcgaagtgttaggtgcctggaaattgtacatttagagtctgagtctcggcccatccagggaacgcatgggattgttagtggacatttcccttgatggtaccttgagaacaaggcaactcttttctttcctttcgagtaaagttgagcagagccttgggtccttgcatctctgctgcagagatttgcaaattcatcaagtgtctgcccacaaaagcgtcctgtagtttctggatctgggatgcactgatcacctggaagtaggtcaggcttgtttgagtgaagtcagcacccttttggcacagaagatccaccaggacagacttagtctatctaaaatccttttaaaatcctgtaaggggagaaacttctcaacttttttcactcatcatgagcagatgaacaacctccaggaactcagcttgtcttgcttctgcctcacagatcagctggacaaaatttccgggtgagaggttggggagggacctgggttccctgaatgccccattacgaacaaaagagtgcgactattcttagatattcttaaacactttgtaacctatttctccttccacatcagcacgggcactgctgggtgttttaaactggccaagctagagagtgtggtccctcatgctgaggagaaagacaggattagaaaagtcagctgtgcccagtcagtcagtcagtcagtcagtcaatcaaccatgtgcagacgtgcagacactaagataagtctgtcgacatattggcgaaaaagacaacagtcctgcttttattggagtgtgtagccttctagagaggaaggggaggcattcagtcggagaaataactgacgctgtagcactgatgcacatccccatgggctggtcacaataggtaataccgccagatcgttttgttcctgtagttttcccgaggcttaggacctgaatggagaacctgtcatttggaaattcgtcaaagggaattctcagtcggctgctttcccagacccatccccatcaaataactgaactagatacactgctaattatactgtaggcactaagttaaattctttttcccttaatctgtcccacaaccctctataataattgctattgtgcacatttgaaagattaaaaaactgtatctcagcgtggaaaagtaactttcttagggtcacaaatctattaagtctgactgtaaagtccacagtgttaactgctgttgcaatggatatacagattactttattctagagtcataagtatctataattcagggctgcttgctctaatccaaccctcattcttcagaaatgccttccttttttctctctacagagccctgccatctcatttgtacacactgtatgtgtctttctgtggactttctaccagagagacatcactgtcctatcccagagctctgaggttacccacctaagactgttgagtctgagtaacaatcagatatcctgggaagtttctgagccattccaggctctgctggagacggtctcagggaccctgcagcatctggagatagacaactgcctgataactgattctactttctctgttgtcatcccagccctgagccactgttcccacctctgtgtccctagctttgtcttcaaccccattacaatgcctgtgctcacgagtcttctgcagcacttaacagcgttgatggagctgaagcatgtgatttatcctgtccctgtccattgctatgaacaatggcaatcacatggcagtttggacatacaagcttgctaaagtgcaggcctcattgaaggtgatgctgcaggcagtaccacagaacgacatgaactagaccacccattctcagtgatcttcacaggacaaggagttgtttcatcactgatgtgtggccactaaaatactgagtgttcttgcctgaagcccaatttgtaaagacacataatgtgccattctgctattccaggaaactggtgttaggaagattggatatgtaactgacctccataaaagaaaaactctaagaaggaaacagcagactttacgaagtcttgtgggtctcttgcccattgtcctctacgtcctccttcttgttactgaccacagtgttgggtacgtgacatgggctgacccagtcgtggcacaccatttccctgtccacactgatcggttcacttatgggtacttgacgcaagtcaggacagttgaaacctttcctggatgtttttctggagtaggtgctggttactgaagccaataatattactcactgaggtcctttaatcttcctgtattcatgattgccttaggttgcttatgacaaaccattggcaattaaaatgaaaaacaagaacaacaagaaacaaactatccccactacctactggtgtctttatcagtatattgctatctcctttcctaggtctcagaagcctggggttcagtttgcccttatttcacacagattcaccaaagatctgttattagctaggtactgttcctggtgctaagaatgaataggcaaacaagaccctacaccaagtcactcacagtacagatcttcctatgttttgtctgtttccccgctcttttcttaggggatttgggaaagttattttgcccatctatggcccagaatttttttttttttttttttttttttttttttttttttttttgctttgccccttgcatactctgctcaatccacattggcctctttatgctgttggatagctcatcaagactcaggccgtagcttagatgttacgtcctccgagaggtttttctcttacttccctctccttacttaccccacttctctcccattacttcccttacttcaccatgctgtttttaaatgtaccatgtacatttccttcatggtacacatcattccatatgtatttgctccctctgctcctcccctagagttgcactattcagtatagtaaacactagccacatgtggctactgagcactagaaatttggctactccaaaatgtgatgtacgataactgtaaaacgcacacggtatattcaagacttagtgagaaacaaaaaatgtagaataactaactaataacttatttgtattgtttacgtgttgaaatgataagttactgcaggtcaaagacagtaaaaaaagaagacagagtactaatgtgtttatattgttcaacatgttgaaatgatagcactgcggcaaagacaatcactctcagcattcctattgaatacctccttggaagacccaaccggtacaataaagcaaaggaaagcactaaaaggcacacagattggaaatgaagtcatgaaaaagtgtccctatttactgacatggtggctatgtataaaatttctgggaatttatgaaaaacctcctagaactaatgagtgagtgtgcctaggttgccgtataccaggtcaatattaaaagtaggtcaactctatttttatatacagtcctccctttgcacagttctgatatgcactaaggtcattcaccgtgatttagttaaataacactagtcccttcacagtatgggtcaaatttcagttaccatggtaaactaactgtcagtaactacataaagaccaaacattgctgctggttcttcagtccacaaatcgctactgaaataacagatgagaatcatgatcagtggccagtcatgtcacttctttcaaattctgtttgtgtcgctccacaaatcactatttaaataatagatgagcatcaggatcagtgaccagtcatgtcacttttcttttaaaatctaatcatgtttggtcactgagtatctattatttatttcatgcatcaacagcaaagaatgaagctgagtttcctccttgtctcccagtgaactactcatatgacattttaccaaagaactggatagtttaaaaaggtaattggccaacaaagacagaaacatgcaaacaaatgacaagaaataatgctggaagtggaaattgcaaaacggttttgatggaaaggattaagatatcccagtgaaagtgacacttgcaaaaaactttacactacaggattccttggagatattcatgacacagaaagaacaaagaataaagttgtggaagctgatcaacactcaaaactgagaaacaaaatttgccaagtcacgggaaaaaatgtctactccatatcacaattaataagatgagaagaaggcaagaactgttcatactactctttttttttccatgagaaattctggatttaattttatttggaatgtcaccaacttctctggcataacatatggtataattatttttagaatgtgattactttatgaatatttgaagacatttttatgttttgagcacttttctgaaacaatagcttctgttttagtgcatagtagtggacaaggccagaattgatgtttttctgtaacattaagctagtaatggtagaagcagttagataaattcaagtcccttgactccagtcacaagacttcctctaaattattgtgactttgtaaaatattcttaatttgaattttttttttattaatccaatagttatttacattgatcttaagtaaaatttgtatgtggcggccaggcacggtggctcacgcctgtaatcccagcactttggaaagctgaggcaggcggatcacttgagatcaggagttcgagaccagcctggctaacatggtgaaaccctgtctctactaaaaaaaaaaaaaaacaaaaaacaaattagtcagttgtggtggcgggcgcctatagtcccagctactcaggaggctgcggcaggacaattgcttgaaacccggtaggcggaggttgcagtgagccgagatcatgccattgcaccccagcctgggcaacagagtgagactctttgtctcaaaaaaaaaaattgtatgtggctacttattgttaatttcactttcattgacatttctactttcacttcacagtgctttaaaaataggcaggccaacattcagattcaggaaatacagagaacaccacaaagatactcctcgagaagagcaactccaggacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgggggccaatattcaacattcttaaggaaaagaattttcaacccagaatgtcatatccagccaaactaagcttcataagtgaaggagaaataaaatactttacagacaagcaaatgctgagggattttgtcaccaccaggcctgccctaacagagcttctgaaggaagcactaaacatggaaaggaacaaccggtaccagccactgcaaaaacatgccaaagtgtaaagaccatcgaggctaggaagaaactgcatcaactaacgagcaaaataaccagctaacatcataatgacaggatcggattcacacattacaatattaaccttaaatgtaaatgggctaaaggctccaattaaaaggcacagactggcaaattgggtaaagagtcaagacccatcagtgtgctgtattcaggaaacccgtctcacgtgcagagacacacataggctcaaaataaagggatggaggaagatctaccaagcaaacggaaaacaaaaaaaggcaggggttgcaatcctagtctctgataaaacagactttaaaccaacaaagatcaaaagagacaaagaaggcccttacataatggtaaagggatcaattcaacaagaagagctaactatcctaaatatatatgcacccaatgcaggagcacccagattcataaagcaagtccttagagacctacaaagagacttagactcccacagaataataatgggagactttaacaccccactgtcaacattggacagatcaatgagacagaaagttcacaaggatatccaggaattgaactcagctctgcaccaagtggacctaatagacatgtatagaactctccacccgaaatcaacagaatatacattcttttcagcaccacaccacacctattccaaaattgaccacatagttggaagtaaagcactcctcagcaaatgtaaaagaacagaaattctaacaaactgtctctcagaccacagtgcaatcaaactagaactcaggattaagaaactcactcaaaaccgctcaactacatggaaactgaacaacctgctcctgaatgactactgggtacataaggaaatgaaggcagaaataaagatgttctttgaaaccaacgagaacaaagacacaacataccagaatctctgggacacattcaaagcagtgcgtagagggaaatttatagcactaaatgcccacaagagaaagcaggaaagatctaaaattgacaccctaacatcacaattaagagaactagagaagcaagagcaatcacattcaaaagctagcagaaggcaagaaataactaagatcagagcagaactgaaggggatagagacacaaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatatcactactgatcccacagaaatacaaactaccatcagagaatactataaacacctctatgcaaataaacttgtaaatctagaagaaatggataaattcctcgacacatacactcgcccaagactaaacctgggaagaagttgaatatctgaatagaccaataacaggctctgaaagtgaggcaataattaatagcttaccaaacaaaaaaagtccaggaccagatggattcacgcccccgaattctaccagaggtagaaggaggagctggtaccattccttctgaaactattccaagcaatagaaaaagagggaatcctccctaactcattttatgaggacagcatcatcctgataccaaagcctggcagagacacagcaaaaaaagagaattctagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatacacaaatcaataaacgtaatccagcatataaacagaaccaaagacaaaaaccatatgatcatctcaatagatgcagaaaaggcctttgacaaaattcagcaacccttcaagctaaaaactctccataaattaggtattgatgggacgtatttcaaaataataagagctatctatgacaaacccacagccaatatcatactgaatgggcaaaaactagaagcattccctttgaaaactggcacaagacagggatgccctctctcaccactcctattcaacatagtgttggaagttctggccagggcaatcaggcaggagaaggaaataacgtgtattcagttaggaaaagaggaagtcaaattgtccctgtttgcagatgacatgattgtatatctagaaaaccccatcgtctcagccccagatctccttaagctgataagcaactgcagcaaagtgtcaggatacaaaatcaatgtgcaaaaatcacaagcattcctataccccaataacagacaaacggagagccaaatcatgagtgaactcccactcacagttgcttcaaagagaataaaatacctaggaatccaatttacaaggaacgtgaaggacctcttcaaggagaactacaaaccactgctcaatgaaataaaagaggatacaaacaaatggaagaacattccatgctcatgggtaggaagaatcaatatcgtgaaaatgaccatactgcccaaggtaatttatagattcaatgccatccccatcaagctaccaatgattttcttcacagaattggaaaaaactactgtaaagttcatatggaaccaaaaaagagcccgcattgccaagtcaatcctaagccaaaagaacaaagctggaggcatcactctacctgacttcaaactatactacaaggctacagtaaccaaaacagcatggtaccggtaccaaaacagagatatagaccaacggaacagaacagagccctcagatataatgccacatatctacaactatctgatctttgacaaacctgagaaaaacaagaaatggggaaaggattccctattttggaaatggtgctgggaaaactggctagccgtatgtagaaagctgaaactggatcccttccttacaccttatacaaaaattaattcaagatggattgaagacttaaatgttagacctaaaaccatagaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccgtcagagtgaacaggcaacctacagaatgggaggaaaattttgcaatctactcatctgacaaagggctaatatccagaatctacaacgaactccaacaaatttacaagaaaaaaacaaaccaccccctcaacaagtaggcgaaggatatgaacagacacttctcaaaagaagacatttatgcagccaaaagacacatgaaaaaatgctcatcatcactggccatcagagaaatgcaaatcaaaaccacagtgaggtaccatctcacaccagttagaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgatgtaaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtagggacatggatgaagctggaaaccatcattctcagcaaactagcgcaaggacaaaaaaccaaacaccgcatgttctcactcttaggtggggattgaacaatgagaacacatggacacaggaaggggaacatcacacaccggggcctgttgtgtggtggggggcacgggggagggatagcattaggagatatacctaatgttaaatgacgagttaatgggtgcaggacaccaacatggcacatgtatacatatgtaacacacctgcacgttgtgcacatgcaccctaaaacttaaagtataataaaaaaaaaaatgacctgttggatttctactttgatgaagttaatgtcatttttaggcctaaaactttttcttttttaaaaaaatcttcaggtgtttttaaattttatttcattttgttttaagttccaggatacatgtgcatgacgtgcaggtttgttatatagacaaacgtgtgtcgtggtttgctgcacctatcagcccatcacctaggaattaagccccgcatgcattagctatttattctgatgttctccctcccccggtgcccccgaccaggccccactgtgtgttgttcccctccctgtgtccatgtgttctcgatgttcagctaccccttttaagtgagaacatgtggtgtttggttttctgttcctgcattagtttgctgaggataatggtttccagctccatccatgtccctgcaaaggaaatgatcttgttcctttttgtggctacatagtattccgtggtgtatatgtaccgcattttctgtatccattctattattgaaggccatttgggttgattcattgcctttggtattgtgaatagggcagcaatgaacatatgcatgcatatatatttataatggtatgatttatattcctttgggtatatacccagtaatgggattgttggttcaaatgatatttctgtttctaggtctttgaggaatcaccacactgtcttccacaatggtggagctgacttacactcccaccaacagtttaaaagcaatcctatttctccacagcctcgccagcatcttttgtttcgtgactttataaaaaccgccattctgactggtgtgagatagtacctcacagtggttttgacttttatttgtctaatgatcagtgatgttgagcttttttttatatgtttgttggccgcataaatatcttcttttgaaaagtgtttgttcatgttctttgcccactttttaatggggttgtttgttttttcttgtaaatttgtttaagttccttgtagattctggatattagacctttgtcagatggatagactgcaaaaatttccacccactctgtaggttgtctgttcactctgatgatagtttcttttgctctgcagaagctctttagtttcattagatcccctttgtcaatttttgcttttgttgcaattgcttttgatgtttttgtcatgaagtctttgcccgtgcctgtgtcctgaatggtattgcctagattttcttctaggatttttatagttttgggttttacatttaagtgtttaatccgtcttgagttaattttggtataaagtgtaaggaaggggtctggtttcagtttactacaggggtctggtttcagtttactacatatggctagccagttctccaagcaccatttattaaatagggaatccttaccacattgcttctttctgttaggtttgtcaagggtcagatggctgtagatgtgcagtcttatttatgagatctctattctgttccattggtctatatgtctgtttttgtaccggtaccttgctgtttcactgtcaagtgctggaaaaagaacaaaaggaactgtctctcattgtcgatggaagtataaaatggccaagacactttgaaaaacaatttggcaggtttgcatgaagttaaaggtacacttatacagcaatcgcactccagggtatttacccaagagaagtgaaatccttcttcccaggaaaccttccagcaaaacgttcttaattgctaaaaactggaaacatctcaaatgcccatcaactggggaatggataaacaaattgtggtatgtacctacactggaagactactcgacaacaagacagttctaagtactgataacataatatgcgtgccacagaatggatgactctcaaaatacattatgctaagtgaaagaagacatactcaaaagactacatacaatgccatttctttggctttatagaaaagggaaaactagagagagaacaaatcaatcagtggttctcttgggctatagaagatcaactttaaaagggcatgagggcactttatggaggtttggacatgtcctagatcttcattcttgggttgatcacatggttgcatgcttttgtcaaaatgcacagaatggtggactgaaaaggggagaatgttatactatgtctcaaaactcggcaccttgattgttattttgtaacctgcctttctccccactgtgtcctgaatcagcaaaaactctatcggttctagggcgtgattcctgctgtaatccccaactctgacagactgtcatccctgtattcctgattctgacctggtttgcctctgatttggaagatatgctttctcagatcctctgccactcttactcattaaccttactcagagcctcctgaaactcactcagtgcaatacaaaggagggatccacagctgcacagaaggtggttgtcagtttctggcttttccatgattcttctgagatgtgttgactaggagtccctgggcttcatccatagattcattctttcaccaaatatgtgttgaacattttccatatgcggtggattctgtcatcatttcctgtttattctccactgcctaacccagaaccagatgttcacgatgtccagttaacaaacgcttctggagcacatatgatgctctaagccctgtgcctggcaccagaaagacagataaattggaaaagaccatctttgtcatctctagcgtcacatgccctccgtggtggacataaagatctattaagcatgtcttttattttctgtgtcgtgatgctttgacatcctgggccttgctgaccctggaaggcttgctcctcccaggcctggtaaggcaattcttagaaatagtaaacaccttgccctggagcgtgcttttcaaatgcaaacaaatcaacggggatacaatacctcccaaccatgtcctatatagggctctcacaccctgggtcactatccacctgccctaatcaccccaaggccaggtaccaggcaactagggacagcccctatgccccaaggctgcttaaattattcagactagccaatcctaaactggttactctcccttgcctgttccttcccacagaggcagagacaacaacaaatgctctggcttgcagttctcctgtctccctctggcccggaccaaccatggtgcttcgccatgagatttcccatgtctgggcatcctttcttctcttcggaactgtgactaacaatctgtctctccaaggcagtcatttcctgatctgtttcaaatgttctactaatccactctattttaaaacactctcagattcccctttaggatgttttcctcgctctgctgggagtgctgtccacagacagccttcagctaccagcttccttggagagcaccttggctccggagagcctccttgtttttccagtggcccacattcagtgactggtggaggcaggagtataaaatcagacatttttaatcaacgtaagaaaaccccaagggtcatttttagcttcagagtaccccatggagctggctgagggtaatgagacctcatagtagctcatttccttccttttccaaattctgtgttctgactgtgctctccacaggtactcatcccatatgtactctcacataaacatcctgcacaataaaatcagtcacacagactatctgttgcagtgcttcaagcatttgaaaaatatggtggagattgtaatggataaataagattctatggctactactaagctcaactgacactctagaagaagacaaagaaatcagagagaaattattatgcacttgaaagccgactgcgaaagccacagggcttccttgggattatacggagactttcaactcctggcacaggatggcagagaaagcttgtgatttaataatcatagaagtaaacctccaaagaaggttaaatttccacccaaagtaggaccgtttctccaggttcatggctcgcactgggcaaaattgagacccataatgtagtttggaatgagacctctagaaacctgaatttccacaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaagaaatcaagactgatgacaggtatactgaagagtttcgcagcccttccaacccctgccacaggaaactcgggatcctttgttcaattcctggacctgaatcaattttttacatctggaactttttgactgaaaaggaggttgggtacccaggcagagaaggtctgtgcagcaccacagcctgtggacacagtaatgattcacccagacctcccctcaagaggcatccatccgttgattcacgtcaccatgaactgtggaaaggaaaatgcccaggtatcttgagaaatgtcaagcatggagtaggagatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcttcctcttcctcttcctcttcttccttcttcttcttcttcttcttcttcttcttcttcttcttcttcttcttcttcttcttctttcttcttctatcccttcaagcatttattctttgagttgcaaacaatacaattgcattccttaagttattttaaaatatacggttaagttattattgactatagtcactgtgttgtgctatcaagtaataggtcttattcattgtttctggttaaccattaaccatctccaccacttccccaactccccactaccaatcccagcctctggaagccatccttctactttctgtgtccatgagttcaactgatttgatttttagatcccacaaataagtgagaacatcagatgtttgtctttctgtgcctggcttatttgccttgacatgacgatctccagttccctccatgctgttggaaatgacaggatctcattcttcttcatggctgaagagtactccattgggtatgtgcaccacattttctttatccattcatctgtcgatggacacttgggttgcttccagatcttagctgttgtaaacagttctgcagcaaacataggagtgtagatatatctttgacatactgatttcctttcctttgggtatatactcagcaatgggattgctggatcatatggtagctcaatttttagtttttggaggaacctccacacggttctccaaatggttgtactaatttacattcctaccaaaagtgtgggaactttcccttttctccacatccatgccagcatttgttactccctgtcttttggatataagccatcttaactggggtgagatgatatcgaatttttgacttgtgtttctcggatgatcaatgatgttgaacaccatttcatatgcctgtttgccatttgtgtgtcttcttttgagaaacgtccattcaaatcttttgcccatctttcgatcagattattagattttttcctatagagttgtttgaaatccttgtatatgctagttattaatctcttgtcagaggagtggtttgaaaatattttctcccattctgtgggttgtcacttcactttgttgattgtatcctttgctgtgaagaagctttttaacttgacgtgatcccgtttgtccatgtttgctttggtcgtctgtgcttgtggggtgttgctcaagaagtctttgcccagacctatgtcctggagatttttcccaatgttttcttgtagtagtttcagagtttgaggtcttacatttaagtctttaatctattttgatttgattttcgtatgtggggagagataggggtctagttgcatttttctgcatatgggtggtccaggttttccagcacgatttatcgaagagactgtcctttctccagtatatgttcttggcacctttgtcaaaaatgagatcactgtaggtgtatggatttctttctggactcccgattctgttccattgttccatgcatctgtttttatgccagtaccatgctgtcttggttactatggctctgtagtattatttgaagtcaggtaacgagattccttcaggtttgttcttgcttaggatagctttagctattctgggtcttttgtggttccatataaattttaggaatttttttttctatttctgtgaatagaaatagtatcaaaataggtattttgatagggattgcattgaacctgtagattgctttgggtattatggacattttaacaatattgattctttcaatccatgagcgtggaatatttttccattttttggtgtcctcttcaattttcttcatcagtgttttatagtcttcattatagagatccttcacttctttggcctagttaattcctaggtgcttaattttatgtgtggctattttaaatgggattactttttaaatttgtttttcaggtagttcactgttgccagatagaaatgctactgatttttgtatgttgattttgtaccatgcaactttactgaattagttgatcagttattagtagttttcttgtggagtcttttttttttttccaaatataagaccatatcatcagcaaacaaggataatttgacttcttcatttccaatttgaatgccctttatgtctttgtcttgtctgattgctctagctaggactcctagtactatgttgaacaacagtggtgacagtgggcatccttgtcgtattccagttcttcaaggaaaggctttcagtttttccacattcggtatgatactagctgtcagtctgttgcatatggcttttattatgttgaggtatgttccttctatacccaggttgttgagggtttttatcaggaagggatgttaaattttttatcaaatgctttttcagcatcaattgcaatgatcatatggcttttatccttcattctgttgatctgatgtaacaccttgattgatgtgtgtatgtagcaccatcctcgcaacccagggataaatcccacttggtcaagattaatgattgttctaatatattgttgaattgggcttgctagtatttggtggaggatttttgcatcaatatgcatcagagacaatggcctgaagttttctttttctttcattctttttgttttctgatgtttctttgtctggttttggtatcagggtaatactggcctggtaaaatgagtttggaagtactctgtcctcctctcctttttggaatagtttgagtaggattggtatcagttcttctttaagtgtttggtagcattcagcagtgaagccattgggtcccaggcttctctttactgggagagtttttcatatggctttgatctcgttacttgttattggtctgttcgggttttggattcaatcttggtaggatgtattgtatctaggaatttgtccatctcttctaggttttccaatttattgacatatagttgctcatagtagtagccactaatgatcctttgaatctctgcagtatcagttgtaatgtctcctttttcatttctgattttatttgcgtgtatcttctttcactttttcttagttagtctggctaaaggtttgtctcatttgtttaacttttcacaaaatcaactttctgtttcagtgattgttcagtgtattgttttcttcagttcaatttcatttatttctgctctcctctttattatttttcttctactaatattgggtttggtttgctctttcttttctagttctttaagaggcatcgttacattgtttatttgaaaattttcctcttttttgatgtaggcacttatagctatgaacttccctctgagtactgcttttgccatatcccagaggttttggtatgttgtgtttccattgccattcgtttcaatttccttcttaatttctgcattgacccactggtcattcaggagtatattgtttaatttccatgtatttgtacagtttccgaaattcctcttgctattgatttctagtcttattctattctatcgtggtcagagaagatgcgtgatattatttcagggttttggaatgttttacgacttgttttgtgacctaatgtatggtctgtccttgagaatgatccatgttctggggaaaagaatgtgttatctgcatctgctggatgaatcgttctgtacatatctgttagatccatttggtctacagtgaagattcagtctgaggtttctttgttgattttctgtctggaagatctgtccagtgctgaaagtggggtgttgaagtctccagctgttactgtgtcagggcccatctctctctttagctctagtaatatttccttcatgtatctgggtgctccagtgttgagtgcatatatatttaaaattgttacatcctcttggtgaatcgacccgtttatcattacatagtgacgttctttttcttttcttatagtttttgtcttgaaatctattttgtgtgatataagtatagcggctcctgctcttttttggtttccattggcatggggtatctttttccatccctttatttttagcctgtgtgtgctttataggtgaagtgtgtttcttctaggcaagagatcaatgagccttgtttcttcacccattcagccagtctgtgacttttgatgggagagtttttccaatttgcatccaatgttacggttgacatgtaaggacgtagtcctgccattttgttatttgttttctggttgttttgtgatcttctcttcattctttctttccttcttgtcttcctctagtgaaagtggttttctctggtgataagatttagtttcttgctttttattttttgtgtatccattgtatttttttttttttttttggtttgaggttaccatgaggctcaataatactatcttataacccattattttaacctgatagcaactgaacactatttgcacaaacaaacaaacataaagcaagcaagcaaaaagaaaactaatgaaaactctgtgccttaacttcatccccccacgttttaatattttgttgtttctatttctatatcattgcattgactatgtctcaaaaagttgttctagttattaatttttattggttcatcgtttagtctttctacttagggtaacacgagtttgtacaccacagttacagtgtcattgtattctgtgttcttctgtgtccttactattaccagtgacttttgtaccttcgggtgataatttattgctcattaacgtccttttctttctgattgaagtacacccctcagcatttcttgtaggataggtctggtattgatgaaatctctcagcttttatttgtctgggaaggtctttatttctccttcatgtttgaaggatatcttctagggtatatactattttagggtaaaagcgttttttgtttttttgtttgtttgttttccttcagcattttaaatatgtcataccaccctctcctggcctgtaaggtttccactgaaaagtctgctgccagacatttggagcgccattgtaaattacttgtttcttttctcttgctgctttcagcatcctttctttatccttgttctttgggagtttgaatattaaatgccttgaagtagtcttctttggattaaatctgcttggtgttctgtaaccttcttatacttggatattgatatctttctctaagtttgggaagttctctgtaattatctctttgaataaactttatactcctatctcttcatctccctcctctttaagcctaataactcttagatttcccccttcgaggctgttttctaggtcctgtaggcatgcttcatttttgtgtattttttcttttgtctcctctgactgtgtattttcaaatagcctgtctgcaggctcactaattctttctttctgcttgatcagttctgctatcgaaggactctgatacattcttcagtatgccagttgcatttttcagctccagaatttctgcttgattctttcagattatttcagtctctttgttaaatgcatctgatagaattctgaattcctactctgcattatcctgaatttctttgagtttcctcaacaaagttgttttgaattccctgtctgaaaggtcacatacctctctgtctccaagattggttcctggtaccttatttagcttatttggtgaggtcgtgttttcctggatggtgctgatgcgaatatttttttcttcagtttctgagtatgtgaactgttaggtattaattgtagtcttcactgtctgggcttatttgtagccgtccttcgtcagaaggcttttcaaatatttcagaggacctgggtgtttggatctaagctgtgtctgcttcagggggcaccccaagctcagtaacgctgtggttcttgtagactcatagagggcaccaccttgatggtcttggacgaggtccgggagaattctctggattaccaggcagagactcttgttccctttccttactttctcccaaacatacagagtctctctctctctctctgtctctgttctgagccacctaaagctgagggtggaatgacacaagcacccctgcagccaccactatgcggccaccactactatgactgcactgggtcagacctgaagccagcacagcactgggtctcccccaaggcctgctgtaattactccttggctactgcctttgtttgctcaaggccctggggctctacaataagcaagtggcaaagccagctaggactgtttttcccttcattggagagaggtcccccaagccccaggtgggtccagaagtgccatctgggaatcagggactagcatcaaaaaccttagaaggctacctgtggttctaagtattgtggctgagctgtcactcaaaccacaggacgcagtctttcccactcttccctccccttcccaaaggtacaagagcctcacactgtagccaccgccaccctaggccccgagcagtactggcagactactgccaatgttcccttaaggctcaaggtctcgtaagtcagctgtcgtgaatgctgcctggcctgggactcacccttcggggcagtgggctcccctgtggctcagggcaggtccagaaatgcagtccaagagtccagtcctggaactggggactccaagggtctgcttgatgctctaccccactatggccatactggtacctaagatgcaaaacgaagtcccctttacttttccctctgcttttctcaaactgaaggagttttgccccatagccaccacttgctggttatgtaccaagtctcacctgaagccaacaagtctcagaggttcacccaaggccctcgatgtagtgcctgggcatcactgctggttattcagggcccaggggctcttcagtttgcaggtggtgagtgctgccaggactaggtcctttccttcaaggcagtgggttcccttctggcccaggacgtgtctaggaatgtcctctagtagctaggtcctggaacaggggccacgtgactctgactggtgccctatcttgctatggctgggctggtatcccagatgcaagacacagtcttcaccactgttttctttctcccctcctcaagtggaaggaaggggtctccttcggagccacaaggtgtgcagcctggggttaggggacgggtgatgccagcactcccttggctgccccagctggtatctcagtatgtcgtgtgaccccccccctcccccgacccctggtccactgtctctgggcctaattcaacaccaggactcacctaagagttgcagttcttttttttgtttgtttttttgagatggagtctcgctctgttgcccaggctggagtgcagtggcacgatctcagctcactgtaagctccgcctcccgggttcacgccattctcctgcctcagcctcctgagtagctgggactacaggtgcccgccaccacgcccggctaatttttttttttttttgtatttttagtagagacggggttccaccgtgttagccaggatggtctcgatctcctgacctcgtgatcctcccgcctcagcctcccagagtgctgggattacagccgtgagccaccacgcccggccagagttgcagttcttatggcctagtctgcctttcaaatttacttggagacacagagtgctgtagcctgccatggtgaggtttgtgggaactcaagttctgatcactgggatcagtgattcccctctggctagggctgctttaaatgctccctctgttgggggggcatgagctgagtttggtccggttttcctttctgctctaacaggatagcactgaggtcattgcttcacaaatgctgtggtctccctccccctgcacccagagatgctctccacaccatgctgctgtggccaggggtgggggaggggtggcgtcggtaattcaggactatgttttggttctcagggagaatgcttccaggttttggcctttgagtaggatgttggctgtgggtttgtcctagatgactcttattattttgaggtatgcttctctgatgcccagtttgttgagggtttttgacatgaagggatgttgaatttcgttgaaaacctcttctgcatctattgagatgatatgtggttttcgtttttagttgcgtttatgtgatgaatcacatttattgatttgcacatgttgaaccaaccttgcatcccaggagtagggcctacttgatcgtgatggattagttttttgatgtactgctggaatcaatttgctggtattttggtgaggatttttgcatctaggttcatcaggaatattggcctgaagtgttgtattttcactgtgtctccgtcaggtttgggaatcagaatgatgctggcctcgtacaatgagttagagaggagtcccagttcctcaaatttttggaatagtttcattagggattggttacagctcttctttctgtgtctgatagaattggactgtgaatccgtctggtccaggcctttggttggtaggtcttttttattactgattcaagtttgaaactcgttattggtctgtccagggattcagtttcatcctggttcaatcttgggaggttgtatgctcccaggaatttatcgatttcctctgggttttctagattatgtgcatacaggtgttcataatagtcgctgaggatttttgttgttgttgctgcatttctgtggggtccgcagtaatgtcacctttgtcatttctgatggtgtttatttgggccttctctctctttctttcttttccttgtttgtctagctagcagtttgtcgagcttatttattttttcaaaggacctttggttcctttggtttctttgaccttttgtagggtggttcacatctcaacttctttcagttcagctctaatatttgttatttcttttcttctgctagctctggggtcactttgctcttgtttctctagttcctctaggtgcgatgttagattgctaatgtgagatctgtctgactttttccatgtaggcacttagcaccataaactttcctcttaacactgttttagctgtgcccccagagattctggtatgttgtacctttgttttcaatagcttcaaagaatttttttgaattctgcccaaattttgctctttactcaaaagtcattcaggagcaggttgtttaatttccatacaattgtttggttttgagacatcttcttggtattaatctctattttcattgcactgtggtccgagagtgtggctggtaatgatttcaggtttgtttttgaattttttgagaattgctttacggccaaacatgtagtcgaccttataatataattgattggttttgaaagatctatatataattgtttgcctctgagagatcttcctgctacagatgtctatttttattgcactgcggtctgagagtgtggctggtatgattccgggtttgtttctgaattttttgagaattgctttatggctgagcatgtggtcgaccttagagtatgtgccctgtgcagatgagaagaatgtatattgtgttgttgtttcgtgcgatgttctgtggatatctgttaggtcaattctgtcaagtgttgagtttatgtcccgaatatctttgttagttttctgccccagtgatctagcactgtcagtggggtgttgaagcctcccactatgattgtgtggttatttaagtttctttgtaggtctctaagtgattgttttgtgaatctgcgtgctccagtgttgggtgcatatatattaaggatagttaagtcttcttgttgaattgaaccctttatcattatgcagtgcccttctttgtcctttctgatcattgtgggtttaaagtctgtttcgtctgaaataagaacagcaacctctgctcttttctgttttccatttgcttgatagatctttctccatccctttactttgagcctatgatgggtgtcattgcatgtgagatgggtctcttaaagacggcatgcagttgggtcttgcttctttatccaacttgccactctctgccttttaagtgggggcgtttagcccatttacattcaaggttaatattgatatgtgaggatttgatcctgtcactgtgccgttagctggttgttatgtagacgtgattatatagttgcttggtagtgtcagtgggctgtgtacttaagtgtgtttctgtggtgacaggcaacgaccttttgtttccatgtttagcgctcccttaaggacctctggtaatgcagatctgggggcaatgagttcccttagcatttgcttgtctgaaaaggattttatttctgcttttcttatgaagcctagtttggttagatatgaaattcccagttggaatttcttttctttaaggatgctgactattggctcccaatctcttctgacttgtaagagttctgctgaaaggtttgctgttagcctgatggggttccctttgtatgtgacctgccccttctctctggctgcttttagtggttttcctttcaccttgaccttggagaatcttatgactatgcatcttggggatggtcatcttctgtagcatctcactggggttatctgactctcctgaatttgcctctctacctgtctagcgaggttggggaaatgtctgtgggcaatatcctcaaatatgttttccaagttgcttgctctctccctctctttgtgggacaccaatgagtcataggtttggtctcttcacataatctcatatttcttggaggttttgttcatttttgttaattctttttttccttgttttagtctgattgatctgattcaaacaactggacatcaggatctgagattatttcctcaggttgttctagcctgctgttaatacttctgattgtattatgaaattcttgtagtgagttttttagctcaagcaggtcagtttggttctttcttaaaatggccatttaatctttcacctcttgtattgttttattggattccttatattccttggctgccatgtcaactttctcgtgaatctcaatgatctttgttgccatccagattctaaattttatgtctatcatttcagccacataggtctggttaagaaccattactgcagagctagtgtggccatttggagacaagaagacactctggcttttagcattaacagagttcttgggctggttcttcctcatctgtgtgggctgacgttcctttaatgtttgaggttgctgtcctgtggatgggcctttttgcttttacattctttgatgaacttgaggttttgatgtggtataagtcaatttagtcaattggcttcatttctggatgattttggggaaccaagacacagctcagcgctcctgggctgcatgctctacccctgggggctgggacgtgtccatggttttttttgtttgtttgtttttgtttttttttttttttctggactctgaaggtttactgcctgctcttctggaggggctgaggtgttcccattccgctggcaacagcactctgatgggatgttccggccaaagtacttccgtggggcagcggtagggcagcaagggcccccaaatgcatgggctcaccagcgaagcagtgcaggaaggctatgagtgagagtgcatcggtggaggagggctgcgggagggtgcacttgtctgcaggggaccacctgcagaagatccccaactgctaggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtggtgaggcttggggttgggtgcccatggccatgcttcagtgcagcttttcccatgctaaaccctctggactccatgcaggcaagatttctatctctgccagctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcagggtctgtgtccttcctccatccattttcaatgccttctttccaaagatctgtttggaatgtgctggtcttcttgatgatcgggtctcttattgggaggagttcttcctgtctgcatctggtcagccatctttgccccaaagccttcagtaatttttaaatctgagaatgtgttaattttccccttcatttttgaaggatggttttgctggatatgtaattcctgcttgacaggtttctccttttttagaactttgaatatatcgcctactgcttgaggactacatatctcttatgagatacagtctccttactagttatagtaaggagttatcagtaataggaattatcagtaatcaaaaccttccaacaaagtcaagtcttgggccagatgacttcattggtgaattctaccaaacatttaaagaagaattaccaccattccttctaaatctcttccaaaaaattgaagaagagggaacacttcctaactcattccataaggccagtgttagttaccatgataccaaagtctgccaaagccacaacaagaaagctacaaagcaatatcccttatgaataccaatgttcagaatcctagatgaaacgctagcaggcagaaccttgcagtatattgaaaggattacacacccatgactgaatgggaataattgctgaaatgcaaagatgattcaacacatgaaaataaacccatgcactatattaacagactgatgataaaagaccgcatcaccatgtcaactgatgcagaaaaagcacctaacaaaatccaacatggttttataataaaaaccctcaacagattaggaagagaaggatacttccttagcgtgacataaaccatatatggaaatacctatagctaacgtcatactcaatggaaaagactgaaaggttttcccctaagatcgggaacaggacaaggatgcctgcttttgtcacttctaactcaacatactattgaaagctctagacagagtaattaggcaagagtaagaaatagaaggcatctaagatggaaaagaagaagttatcccctgtcacagacgacatgatcttctatgtagaaaaccctagagattccacaaaaaaagctgttagggctaataaatgaatttgtcaaagttgcaagatagaaaatcaacacaccataaccagttgcatttgtgtacactgacaatcaacagtccaagaataattaagaaaataattacatttacaatagcacgaaaagaatagaatactcaggagtagacgtaatcaagacatttaccttgagaactacaacactgcttgaagaaattaaagaagacataaataagtggaaagatgtcctgtgttcatgggttgtggttaattttgcgaaaaagtctttcctgctctgaggacataaacttaggcactctcgtaattgttctaacattttttaaaatttcaatagtttgggggcatacaggtggattttgattacgtggataagttcttcagtggtgattcctgagattttggtgcacccgtaacctgagcagtgtacactgtacccaatagatagtcttcttttatccctcaccctctttccacctttccctccgagtcccctaagtccatcatgtcattcctatgcctttgcaccctcataggttagctcccacttataagtgagcgcatacgatattaggatttccattcctgagttacttcacttacagtagtggctttcagctccatccaagttgctgcagaggccattatttcgttccactttatggctgagtagtattctgtggtgtatatatgccacatcttctttatccactcgttgattgatgggcaataaggttgcttccatatttttgcaattgtgaaatatgctgctataaacatgcatgtgcttgagtctttttgatataatgacttgtcttcttttgggtagatacccggtagggggattgctggatcgaatggtagttttacttttagttctctaaggaatctccataccgtttcccagaatggttgtactagtttgcattcccaccagcagtgtaaaagtgttcccttttcaccacatccactccaacatctattattttttgactttttaattatggccattcttgccggagtaaggtggtatctcattgtggttttaatgagcatgtccctgataattagtgacggtgagcattttttttcatatgtttgttggctggttgtatatctttcttttcttttttttttttttttttgagaattgtctattcatgtcctttgcccacttttggatgggattttgcttttttcttgccgatttttattgagtttcttgtagattctggatattagtcctttgttggatgcagggtttgtgaatgttttctcccactctgtgggttgtctgtttactcttctgagtatttcctttgccgtgcagaagctttttagtttaattaggtcccacttgcttatttttgtttttggtgcatttgcttttgagttcgtaggaacgagttcttgtaaatttgtttgagttcattgtagattctggatattagccctttgtcagatgagtagattgcaaaaatttcctcccattctgtaggttgcctgttcactctgacggtagtttcttttgctgtgcagaagctctttagtttaattagatcccatttgtcaattttggcttttgttgccattgcttttggtgttttagacatgaagtccttgccgatgcctatgtcctgaatggcattgcctaggttttcttctagggtttttatagttttaggtctaacatttaagtcttcaatccatcttgaattaatttttgtataaggtgtaaggaaggaatccagtttcagctttctacatatggctagccagttttcccagcaccatttccaaaatagggaatcctttccccatttcttgtttttgtcaggtttgtgagagatcagatagttgtagatatgtggcattatttctgagggctctgttgtgttccgttggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttacagtagttttttccaattctgtgaagaaagtcattggtagctcgatggggatggcgttgaatctataaattaccttgggcagtatggccaaaacaaccccatcaacaagtgggcgaaagatatgaacagacacttctcaaaagaagacatttatgcagccaaaagacacatgaaaaaatgctcatcactggccatcagagaaatgcaaatcaaaaccacaatgagataccatctcacaccagttagaatggtgatcattaaaaagtcaggaataacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacgtggaaccaacccaaacgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcgctcataggtgggaattgaacaatgagaacacatggacacaggaaggggaacatcacacaccggggcctgttgtggggtggggggacgggggagggatagcattaggagatatacctaatgttaaatgacgagttaaggggtgcagcacaccaacatggcacatgtatacatatgtaacgaacctgcacgttgtgcacatgtaccctgaaacttaaagtataaaaaaaaaaggaatgaattcattacctaagccaatgtctgcaagagtttttcgatggtatcttctagaatttttgtggtttcaggtcttagatttaagtctttgatctatcttgagagttgatttttgtaataaggtgagagatgaggatccagtttcattcttctgcatgtggcttgccagttttaccagcaccgtttattgaatagggtgccctttcctcgctttatgtttttgtatgctttgtcaaagatcggttggctgtcagtatttggcttcatttctgagttctttattctgctccattggtctacatacctgtttttatgccagtaccatgctgctttggtaactatagccttgtggtataatttgaagccaggtaatgtgatgcctcctgatttgttctttttgcttagtattgtgttgattatgcgggctctcttttggttccacgtgaatttgaggatatattttttttctagttctgtgaagaatgatcatggtactttgattggaattgcattgaatttgtagatcgctttgggcagtatggtcattttcaccatattgattccacccatccatgagcatgggatgtgcttccatttgtttttgtcattgatgatttctttcagcagtgttttgttgtttttcatttagagacctttcacctccttctttttccactaaggtttcttttttttttttttaatttctggaatttatattgtgtatggagtgagatagcaatctcctctctaaaaaatgggtataaccaatggatccagcactatatattgaatagcctgtcttttcttcagctaaccttcaatggcaaacctctcatgccacgttttcctatatttaatgggctctctatcctatcaattgtattggcctagatgtcatataagtgaactatcttaactatcttaattattaaaacttgatatcttgtaagccatgtcccttctgatcccctctactttgttttaatattcttggatattaagcgcccttggtccttcagtatgcattctagagtcatagagtctattgttccgtagaaagctgtgttggattttttattggaatcacgtcaaatatacaggttaagtggagaaaaccgtcatctttatcatagggattcttccatgagcatgctttatatctgcctaatttggaactaatagctctcgataacatttgataattttctcatttaaagtctgaagcatctttgttagacttatttccatgtaccttactattttgtggcagttataattggtgttcattgaagagttgtttttcctctaagtggttgttgctggtttgtaggaatacagttgattttcttcttagctgtaattaatgctgagagtttgtagattatctcaggtttttccatacaggtaaataatatattgtctatatagatatgatcgtttgggtgtttttaattccaatcattatatcttttatttattgcactggctagaaccgccactgttgagcagaaatgacaatattgagcaaacttgtcctgttcttgatttttaaggacaatccatgtaaatcttcaccagtgtgcacagctgttggtgcagattattttgtagatatgtgttttccatctgttttttcccagtttggcaagaattgtgttttggtttgtttttgtgtgttccgtgaacaggcactggattttatcaaatgattttaccctgtccattaaaatgatagcccaatcttgtttctttccattaatgggatgatttacattaacattcctttctaatgttaaggcatttttacactgctgtgatacaccaaacttgttctggtttattatcatttctgtgcgtcacttaagtctgcagtatttaatttagcatttagcttgaattataaatttcctttctcctattatacttacctcattttagagtcaagattatcctcataaaatatacttgggagtgtaagcttttatcttggtctttggtgaagtttgtatgaacttggaattaattatctactccttgaatgtttagtggaattttccccgtgttcctggtagttttcttgacgttgttttttttttttttgaactaaagatctattttttttaatgtcaacttttatttttagatagaatggttacacatacaggtttgttacatgggaatattgtgtgatgctgaggtttggggtgtggatcccatcacccaggttttgagcatagtatccaataaataggttttcaacccatatcccctccctgccccctcgagtagtccacagtaatttctttaatcgttgttaagtctagtcaagttttctatttcttctatagttagtttaggcaggatatgtttctctttcaaaatttctacgttgtctaggcattaatttatatcagtatgaaattgtttttggtattatcttgtttattgtttatgtctaatcatattctgcttgttaatttttaatattgttcctttgtgttctctctctctctcctcctgtccactgctcttcatctttctcccttcaccagtattgccaacgttggctgtttcgtcagtcttttcagaaaccaacttttggtttggttgattttgttgattctctctattgtacttttctttctctctttctttccatatatatatatatatatatatatatatatatatatatatatatatttagttttgtttgttttttttgttttgttttgttttttgagacagagtctcactctgtcacccaggctagagtgcagtggcgccatcttggctcactacaacctccgcctccctggttcaagcgattctcctgcctcagcttcctgagtagctgggattacctgcgcgtgacaccacgcctggctaatttttgtatttttagtagagacggagtttcaccacgttggtcaggctggtctcgaactcctgaccccgtgatccgcccgcctcagcctcccaaagtgctgagattaccatgcccggcctctattgtacttttcttttatacctcattgctttctcgcctcatattattttttctttttatttttctgcttttcttttgctcttctttcaagcatggatatgactctacacagctgcacccaggggtgacctttaaagacagtgcagagaaaagtatctccctgttgtggggtggggggacgggggagggatagcattaggagatatacctaatgttaaatgacgagttaatgggtgcagcacaccaacatggcacatgtatacatatgtaacaaacctgcacgttgtgcacatgtaccctaaaacttaaaggattaaaaaaaaaaaaaaagaagtctgttgaaaagatacactatggaccttgggctcaaagacctacggtaggaagctctgagtaggatgtgagaaaaatcaatgtgacagtgaaaaacaattattatgtacaactcttttatattctaaagaagggggttaagaataaagatccttgatgtgctgatcagggtgatgagtctgaggattcagtcatcagaatctcacagagataaatggctccacagagaaaagagatttgaagggaatgagactgttcaggaagaacaggagctgatgcccatccatctcatgagggtatgaggaagagaggcaagatagtctaacgcagactgtttggtgacatttcactgggacacgtgccattgaatctcccccgtttgtccccatgaagacgtctacaaatgcgcattgaatgttttggtaatcagatttatcattggtttgggggtggggggtgaatttcagcatctactgtcaagcggggcaagagcaaaggtagctcttggcgccctaatagtactctgcttcaataagttagctgtggtcattgcaaattatgtcagcagaagttgagtggttaaacatgggctttaccttcagagaaacggaacaattctgaaaaagaagaaaagagagaagatccaaacttgccacaggcacatgcagcaggttctccagtcctctttagagtggtttagctgtttaaaaacattgggtgggttctggcacgtgcctagtgttttccactcttaccctgtttatgcacctctgtcctgcttccttgatcagctgcccaccagtcctgagattctcccaacatggatcacttctcagtcattgagaagggaatatgagaggaggtctagatcattatgttcttatttggcagtttaattgttaaaaggaacattcaccaatatactcccacctcgacacccacagaacgtaaaaataaactgttgtaggatgtggtacagtggctcttacagggtatactagagaagaatgaggatgtgaagaaaactggggttcacattgagcctggggtggaaatcctggctgttcagggtggtggaaagtgtagggctgattgccattcctatgatgccttccttgaatcctccggtaagtatccacatcttctagtctctgacttcgaccatatttatcacctctaataccagagttctgaagtttgtttcttgctggattagtttctgtggtcttctaaggacttatgacctatacgtctgttttatagcctataaaattttgctaacatatttttcttggtgtggtgtcgttgtctggtaccttctgattttttgtcccgctttgcaccccccgcccccccccacttcattattaggggttttctggtgggagcataaaaagcatttgcactcagtattcctgaagtaatcagaagtaaattgatagattctctaatgttccactaccctttcattcctggaacgaacgcttttttaatagacatatactagttaagtttagtaataattaatttagaagttttgcatctgtaattatatatactataatttttactgctcgtactgtcctttttgaactttcagtgtctaattttaccagcctcatgatagagactttaaaaataatctcattgactttactgacaaatgtcttattatgtctgaaatataatggatctagaacctgaaaaaattagttaatgaaatgcactgaaatgaatggaaagtaggatactcttctatggtttttaaaaattgaggcatttactgagtcatatagtggcccccgccaaattcctgtccaccctgaacctgtaaatgtggcagtatttggaaatagtgttttttcagacgcagtcacattaagatgagatcatattgaaccaggcagggtaggccctaactccaatatgactgctgtccctataaatagaggtagatttggacaaggagacacagacacataggggagtcgcgtggagacagagacagagactggagtaaggcattacaaaccaaggagtgacaaggagtaccagcatccaccaggaactaggagagctaagaaaggcttcttccgtcagatggagcatggccctgctgacatcttgattttgtacttctagcccccagaactgtgtgagaataaatttatcttgcttttagccacccagtttgggtattttgttatggcagccctaagaaactaatgcagattttagtgctaagacgtgggttgttcctgtcacaaatgcctaaaaatatggaagtggctttgtaattgggtaatgactagaggctggaagacttgaggcacatgatatgaaaaccctagattgccttgaagagaccgttggtagaaatatgaatgctaaaggtgattcttgtgagagctccagaaggaagtgagaagagttgtagaggaagtgcttatcatcttagagaacacgtgtatcattatgaacagaatgatgctagaaatatgaatattcaagctgcttatgatgccgtctgagatggaaattagacacatgttaatgagcactggaggaaaggtgacccttgtgatagagtgtcagaaaacttgaatgaattgtgtagaaagcaggtcttgtaagcgacgaacttggatatttagctaggagatttccatgcaaactctggaaggtgtggccttgtctctttatagtaaaacgtgagagtaaagagataagttgaggaaggaactgttaagccaaaaggaagcacgcttgatgatttggaaaattcacagtctacccagatagtgcactatggaaacagggccaaaagtgtggctgaacagccatttgctaatgagactagctaggcatgtggacccaaccaaccaccttggccctaagccaggaaaccagataggttaatccaggaaggacccacacagagcctacatatctagttgtgtggatccccttggcatctgcaaaaacatggcaaggattttgagagttttatactagcagaaacgctgccagcctggactgaaatgtccagagatgggacaaaaatgaaagaagaatgtctctgaaggcagaaacatggaagaccagaccagaaatggcattgtcattaccctggagggctggatggactgagtccctgacccagaaagccaggaagatggggctgcctccctggagggtcctaaagtttggggctgcctccctgaagggcccttgggacagaagattgagccatggaagttcactctcggcctgaaacttaatggacttttttcctgctgggttgtgaacctgccccagagcgacaacccctttaatctttccaccttctcccttttgtgaaggggacgtctaacctacgtccgtcccactgtagtattctggaagtagataacttgttttctagcttcatgggtctgcagacagagaggaacattgccccagggtggaccttgcccaaagtctactcggtaagatcctgacaattttagatgagattttggatttagggttaatgctggaataggtgaagatctggaggatttggagatggggtgaatataatttactcacggtaagaatgtaaatattggggagccagagggcagactctattgggttgaatagtgcgtgcacccccctccccaaatttatgtctacctggaatctgtgaaggtgattttaattggaagcaaggtctctgtagatgtaatcaagtgacgataaagtcacactggactagggtgtgccctaatccaatgactggtatctttataagaagaggaaaattgggacaaagagacagacacacagggagaataccatgtgacaaccgaggcagagattagggttaagctgccacaagccaaggaatgccaaggattgccagcaaccaccagaagctaagagagatgtgtggtacagattctctctttaactgccaccctcaccacaaggtaccaatcttgctgacaccttgatttcaaacgtttggccaatagaaatgtgagagtttaaaattctgttgtttcaagccacccgtttatggaaatttgttatagcagcctgaagaaacgaatacagcacttgagtcctgtttagcaaggatcaagctagagctctttggtcactgtgtctagcctggtgaacatcagtggctgcttggggcagccatatggacattatttgtgattgtgcatccctgagatgggcctggggatgagcccttgtgagttatgcaaaaaaaaaaaaaaaaaaaaaaaggaaggaccccagcaccccagggagacttaagcatggcaccaagttgcctaacagtcattgtttttcaggcatgggtaccacagttgctgccgtagcatgcattctccttaccctcaagcgtattcatgtgcatagccatggcagccggtgtcccagggactgatgattaaataaagagggtggtggaggaggagcgtttggcactcagctgctcccacagtgctaaaccacttagcccttattctatgcagagctatatctaagtttcatttaattctcacgccaaattgaggatcatgatggaaaattttgtctatagctaaatagaaagctgaaactaagaaaggtcaagtatcatgaagtaaaagagaggttctattagtaatagcaaaaacttggacttcaagcactgtgttcctttcatttgtttttaaattttatttattttttaattagacaaaattgtatatatttacggggtacaatgtggtattttgataagtgtatacatttagaaagactaactcaagctaattaatatatccatcatctcacctacttatcacattttgtgttaagaatatctaaaatctacttttaaagcaatattgaaatatatgatacgttgttattaactctgctcactatgctgtgcaattgatcaccaaaacatattcctcctgtctaactgtgctccagtcccaaatcctcagcagtaaaatgcccctgtctctcctcagtgaaaccactcttgattaataaagtagtcttagtgtagtcttacctggggcttagttgtcccagatctttcctgccatccaccagaacctctttgcctgtagagagtcttctgaacttgagaagctgcaggattatgaaagcccagcatgtcatacacttgcctgctcattgctccttctctcaccttggctctcttgtctctcatagcaatgtcatctcaatatcgggcatcatgaacataactcttccggcctgtcacagaaatgaagcaaataaactgatggaaaaaaaaccataaagaaacccacaataccagccacaagtcaaaccatttaaaactgttacttttgtattagtatcagacaaaatagacgttaagacaacaataattatttggaataaagaaggccaccatgtagtcatgatagaacatttatcaaagagctaaaaagtctgaacttaacatgcactcaaaaacatagccaagaaatacataaagcacgatgttcagagttacaagaaggttgccacaataaaatataaaagtgcactattttagagttggggcagttccaagaagtagcaagatccagggagtgcccctgagcatggcagtcaaataagaggtcttgcgaccatgaggcttggaatcagactggttttctacatggacattgaaatcacccaggactgtgacaagattaggtgtagaaactctgaatgagacataaaaatctttgaccaaaagaccaatacgttggttttattttagaaagccatctttgtaagatgcccaggatggccataaaattgaatgtgtattggtcagggatatttaaactacaactaacagaaagtgcaagtctcgctggcttatccaataggtaaagacacttgcttatataactgagagttcagaggcagagtgagtttcatggttaactgagccagtaacggaaagatgtaaacatccaggctaaatcttgacccaaccactgctggattgggcattggattattggattagattagactaattctgggcccactcttggagctaagaaagtggccatatatcctcaagcacatgactctactgggaggagatacactgatggaggcctgagcccagccaggaaggtgaggaatgtatattgtgtaggtaaacaaaaatgtcacctgcaggtacagactcaaattatatataccgctatgagcatagtaaccacaatattcaagtccttcttgtgtcctaatagagtgactcttcgggtaacaaagacggatattttattcaggagctacctatattgaattcatgaataggcggttacaaagcatgagagctctcccctgtgcagtatatgttttggaagaacctcaacaggcatccactgtgggatgcttaaatcccattttcattctttttcgattcgtcggcaaagttttctattcgctcttgtcctgagatgatgttgtgttaggattatttgaccagaggtaactgaattcttcgtatttaccgttaagttttgtctttctgtaaacacgcgacacagacttcacaaagatatcaaagatcctcagatttcagtatggaacaaccttaaaagccctgggtctttagaagaaagtcagactcagccaggcgcggtggctcacgcctgtaatcccaacactttgggaggccaaggcgggctgatcacgaggtcaggagatcgagaccatcctggctaacgtggtgaaaccctatctctactaaaaatacaaaaaaattagggcttggtggcacgcgcttgtagtcccagctactcaggaggctgaggcaggagaatcacttgaacccgggaggcggaggttgcagtgagccaagatcgcaccactgcactccagcctgggcaacagagcgagagtccgtctcaaggagagaaaaaagaagagagtcagactcctataatgtaccaaaattaaagaacaaccttttcctctaatgcacacatttattcacgctttgaaaagaatatgtttccataacaataccaaatatgcatatgaaaagaaaattaaaaataagataatcacccaatctgcgaatatgcagatttgaaaattaattatcaatatataaatggaagctcttaataaagacgttgtagtatcacatagacaagatatgtaatgtgttattgctcatgttttgccttagtctgcatctacactgtgaaatgagcttaatcgtgttcactggttcattatttgctaactccttgattgacttagccagttgagcaatccagccagtgagtcattctataactgttgataaactacgtgatgttttaaatccaaggattaaaagaaaacacaaacattatatatcttgccttttttcacaggatctaatcactgataataaattatcagtgataagctgatcacaagaaacaaggtataaatgctgcatacactaaaaagaaaacaatgtggctgactatgttttaaaaattatctgacagtattttccaacagagtatttagaactatttcttgaattgcaaaatatagttgccttgagcagataacaggaagcaatctgggaaatttaaaattctctacttttaatacattagaaatctttgaatcataattgctcattgttttaaatggtcttcacagtggagggggtttggaccagagagctgcatcttcacaaatggcactgctcttcagtaaacaccctctatggaatccctaccttttcactcctctccatcctttgcctgaaggaagttttccttgtagacataattttgtatttgtatgttgtggtagtcctcaaagagtgagcctattacctagagctgttgaattttaccttgcattgaggggttggcatattgagcaatttgccagggagcactatctgcaactgcttctctttttttcctattgcttggcactgacataaagttacttctagctacgctaatgaatttcacgaaggaacacagaaaaacaggtcttgaatgtaatgcccgtaatgatagagtcccatcttatgctttcccttgtatgctgttgctaggtcagtcatttttactttctgaaagttaatttacataggacacctagttcaggtgtatgtatctgttcaaaccaaaagcgttagagtatttatgtttaatttaacaacgtcgcaaccgttctgatacttaggggagttctgagtaagtaagttctagaaaggggagttccagtactcccctttctctcttttctgtgttaggtaaagccacccctcctaaagccactagcatggatccccaaaatgtccaccacagaacgaaaaggtaaaagaaggagaagttgttcctgttaaatcctgccgtatcacacgcaagagaaatggcttatcaacctgcctcaccccagtaaacacagcgcctaataaattcagtgcctaaactggaccccggacatatgaatctttgtccacagagttaccttcccccactgtttgtgcatattagagcaccgacagacttccattggtgtaacttaaaaaaaaaaaaatcctaacaaagtcctgataatcatctcagagaaagagtgaatgatatgagtatcaggtctgacaggagcaaactgtgaattaaagtaagagttataattaggatttgtcttttggtgaaagaatttgaccatcatcaataccgtgtaagttccagttgagcataggtgggctagataaaattgtgctgtgccttttactggtgatctgttcatctgtatgtaatgatagaaacgggggccagggcagataccaggtcttgaagtaggcttccatcctgtgactttgtatagatacttcctaaatccaacttgaaatttcataataggctctttcataaatatgtagccccattttatatcctctatttacatgtgtcccataaataattctccagaattatccgagacccactgattggcgcttcctagtcattcattccaattatcatgacttcagtctacggccataccaccgtgaacgcgcccaatatcgtccaaatatcatgacttcctttgataaccttagagccactaacacagcctgttgtcctcactagtatattcaactttaactgtggtggaaaatttggtctgttgagttttcttctgcttatttatgtagccaggccacagtgcgggaacctagcaaagtaatcccaatgcttgtatagcattgtttgcctctgcaagcaaatcagaaagactccactccaccaaatttattttggacatgcaggtgaagctgcagtttcccacacaaaccagcaaaacaggtggtcgtgaaattgcgattaacaacaactgcaatgtgtactctccttctcttttctctatcctttctggggagacacaggcagaataaaaatacagtgaaatctaattataattcagattccactcatacaaaattgttgcagttcaggccagagccaggtatgatgttttaaaagtgctaatctttctcttttcagtaatttttttaaagaaggaaatgttttcagctaacctcaaacattttatactgactttcatatatacatattttatatattaatggtaggtttatatgtatacatttaaatgaatctcctgaggtccttaattagattcagcattgactggtgctaattactgacagtacttgaaatttcttagttggtatttcaaagagaacatccaagacctcaactcttcagtaactgggtctggcttccagtttgtgtgaattaataaggctgaactaaaattaatttcctttggaaaacccgggggtggtcagaacagtctagcaccatactgcctgggggagacagctggtttgccacctgcaatgtctgtgacctcttaggcaagtgatttaacgcctctgtgcttcagtttcctcgtctgtaaaattctgttatactacctactccatagagttagcactcttaaatgcggtaaccttttggagtgtgtggcacatactaatcactatacacatttttctttttcaaatgaacaactaaaattcattaggtttgccctaatttcctttggccctgtatgaaattaagtaaacagtgcttacctgtacggactgcttaggctcttgcagtagtgtctatgattatggttttagtgaggaccttcttcattgtgaagtattaaatttcacgtgttgttagaaatgaaacacataaaatatattaaagagggatggggggccgggagcggtggctcatgctgtaatcccagcactttgggaggccaaggcgggcagatcacctgaggtcaggagttcgagaccagcctggccaacatggtgaaaccccgtctctactaaaaaaatacaaaaattagctgggcgtggtggtgggcgcctgcaatcccagctacttgggaggctgaggcaggagaatcgcttgaaccgggaggcggaggttgcagtgagctgaaatcatgccattgcactccagcctgggcaacaagagcaaaactccgtctcaaaaaaaaaaaaaaaaaaaaaaagtgaggtgagggtagcaaaagctcaagtctgtgtgctgtgggaggttatctggaggtaccaccatctcagtaatatgggcaatctcagagctccaggtctcatgaacagaacggtctcctgaaacatgcagatcaggagaactctgcagtggttggattctactgtcaggaagttgacccaagctcacccacctatcctgggtacttgagccttgcaggatcctaaggctgcaagccacgtggatgccaccatcatgtgaacactacaattatgagccctactgatagggccctactggtcatatcagcaccaagggctctaaaactttgaggtcatgtggcctctcttgtcatgttgctcctatggtcatgtgatgggcccagctcttccagtcactacagtatggtggactcctgaaccctgttgctcacatggattcttccctcacctggccattactggctaccagcatgtggaagtctcagccctcgaagtcatatagatgacctactgtttagggtcatgtggatgctatggtcatgtccactgctcccactcacccctccccatggccacagtgtcaggctcattcctctctgtcacgtgaagattgtgagctgccaaactctgcagatgtgtgtgtgggcagccaagtggctcctgtcatctcgtggcaggcaaagcctttgcggtcctgtgagcaccgcagctaaccaatggctgttgtacatgtggctcttatggtcacgtgagattccgcaccctcccattcacgtgaagattgagtgctccgaatcctgtcagagaggtgcttccggctccacaccctgactcaggcggaagttttattggacttcggctcagatctgaagccttccggcaactttcatatcctgacgcgctggaaggaagtctggtacgagtggaaccagccggtactagaagtttactgagaattgggctttaaggcgtggctgagcaatctccaaatagcagaggctctgagggggtggggtggggtggggtgggtggggggtgccgggggtgcgggagggtggggggtgcgggaggtgcgggagggtgggggggtggggagggtggggggtgcgggagggtcggggtgtatggggggtttgggtggaggtagcggaggacttccctaatgtggccgaacttgtgaacacctggcagagaaactgtgtgtgcgtgcgtgtgtgtgtgtgcgtgcgcacccatgcatctatgtctgccatccgccttgatcctggactcacaggagctgttgttggaggagaaggcactggggcagaatgtggggctgggggataggggtagggttggtagtggggcggcagggattcatgaactcgtaagtcgtttctcaggggcagggctgtggaagcctgatgggattccccccccttcccgcccccacactaaaagccctacccttgcctgtcactctgcccgattcaccgtctgtgccaggtgattctgtcctctgcccctcctcagaccatgttgttattaaggacactcgagactgcctagatcccagtttgtatagacgattccagacccaatcttaatttctgtctcttatttgattatgtaaagattctctttgtttccatgatttatttttctactaaaccttctaaacatgggctcaggggggtgggcgaaagggagagaggggaatcgggaatttttttaaaaagagaatttgatatttcaataaaagtgtccaagtcgtcatgatgtgaagattcagaatttacttgttatactttatttgaactccattggctttaaaaagtacatttgggagtgggtgacattttttttgtgtgtgtgtgcgcttaggatctctcagtagcttatagtagtatagcttcacactcttttgtttctgattctccccccatcaacccctgattttctaatgattgcttcttagattcctttctgaaaactctctccttttcttcctgtggaaaaaagtatagtgaatggatttaaggtacaatcatgggtgataacatttggtacatcatgaaagcggtattgggtgaatgaagttgagcaaatagcaagattgtgcttaaacttacggggtttcaaatattgcttgtcagatggttagagaatattgtcacttgtgatatttgatattacatgtaggttgaataatctatttttctctcatttcagcatttccaagttcgttctgtgagactgtagtgtcaggacaaagcaacaacaaaatgtgctctactctaaagaagtgtgggacatacagaactgaaggtaaacgaatactgtaggatttttttagatgatatgctaataaacaacacgagtctcaaagggggggctactttccccaacttgtatgggaatggaacatttttttccacagagcatttgaggtaccagtgttcttcagaaaatatttggggaaaccctgttcagactacatcttctaacactttaaaaccttgtgcctttgtttactcagaacaatggaatgtgggtttataatagttgtaatctagtctgctcattaagacattgattgttgctctttaattcattttatctcatgtcatcagtcagtctctcctgcttgaatctttgtacttttttactcttcagagataccgccaagcatgcatctgataccatggtggtggcagacaatatgtgcataaatgcaagtcattaggaagccttacctgtggcagcaaataaagtgcccccactcttgaaaacaaggtacaacttacctgtcaggacaagcagatgcagtaccgctcattttacacaataaaaaaccacacttcttcagaaccattttattattacttaataattacagctgccatagtttgagcccctgtcatatgtcaagcactgtgataacctcggctgtcatgcaagttactgcatttaaccctcaggaaagtcctgagagggtgttatcttaattgacagatgagatatatgagtcaggagaggctgagtgtaacgctgtgcttataggcaacccccaaacctcagtgacttatttctcactcctgctgcatgtttatgccaggtgcatatccttcacgggatggtggatgttgggttctgagccattcttattggaatgactcagagacccaaactaatggagcagccaccatctagaaaggggttactcactgcgtcagagtgggagagagccgtagagggtctcaaaccaacaaccaaaggttctgacccagaaataacccgtgtcactcgtcactcacaacccattggccagagctagtcacatgcacggccctgccccaaggaaggcagtcgggtcgggcagtcctaccaggtgcctggtacaggggagaatgtaaacacttggtaaatggcagcactgactactgcatgaaggaatcaaagctgggagggattaagtacttgcctaacatcacatcggccgtaagtgacagaatcaggatttgaatccacccaggcgtgatttcaaagtcgatgtcctttctgcttctttctacgctgcctgctcttctcttaaaggaagcttatagtaaaaattcttttacatcaatgatgcaatgccctcttccttaatcatctgatagtttaattgaatagacacgatggcactggttaaaaagaccagcactgataagccagaggtcttttccaaatgagggaatgtattggatatttgaatatccattgtattcaattataaaaataaaaccaggtggtagatgaaaggacttttcattgatcatttacttaatgtggaataatccccatgtcttaccgctatgttgaggaaaaatgataaaaaaatagagcctaccttgatgaaagtgaaaacaccatgtgagagagttgaacaaaattgctagatgtcagtgtttcagaagcgcaggataatgataaaatctctggccacacgggcagagaaaattagcgaggtggtgcgggtcagccacttttggaatgaagatagtgtcacacttacagtgacagaaaagattgaaaaagatcacattatgaaaaggatgtgaaaatttgaaaatttagattaaattgatgaattccaggggaaaaatatatataactttccaaactgaaggaatagaaaaccttggtttattcaatgtattcttgacaaggaatacatgcaaaggcaaaattactagccaacccgaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatcaagcgtatgtgccaacatgagactcagaggtggaactgaataacatgggagccatatgtggggtggactacccgtgatgagggaggtctccagttttcatgcggcagccattgcagagtttctagaattcagtctctgtcatgcatgtcaattaacgggcaggcagcagtggtatttcagctgtagcagttccatcacgtgggtggacttctcctggctgtgcagcatccaggcctgcttttctggccctcacagagtttttgtaagctatgtaatatattttattagagatatcttgtttgtataaaagagctagagtgaattctggcataggcaagttgggaccttgattaacagagtacttggcagcaaaattggttgcaagcaaaagaccttgaaggaaatggggatctggggtagatttggcccacagggcatagttgctgacctctaagctaataagttgctgacctctaagctaatagactcactgggtccccaaaacagtgctgagtgggaagtcagcaaaatgaggaggcagctattgctaggatcctctggcaagcataagccaaaaactgaggctttaacacggttgttttcaaccttggttgcacactgcaattcacatggagagttaaaaaatgtggttgcctggatctaaccacggttctgctttgattgttttgggtgtgtcctggtgctagtgaattgtttcagtgtccccaagtggctctaatgtgtaatcatggttgagaactgcttgaacaatttaaatcataagaatgcaagcctttcacaatatttaattttaaaattttataattgtggtttcagaatgataatattacagtaataataaatacatagttacgctggaaaatatgaaataaagattcccatgtaagacatcgagaagattgtctttttcaaagagaaaggaaatgggaaaacacagtggtaaagccggggccaccacaggttgtgtccggcttgaagctaaactgccggcaaggccagagcaaggtatggattaaagctaagtgtctgtgagcccagggctgattcagcagtggagcttcctctgcagaagacatccacaacccaggatcagcaaggaagggatggcacaaactcaacaaatccaataattggcactgagggaacagaaagaatggaagaggctgaaacagacattaagataatatttccccagagagacaaaggagtgataaaggatgaaattgtgtctattacgaaagaatagaagactgcccaagaaagatggctttttgaaggcaaggatctcctttcacttcctcctgaaacttcattaaaacaacatcaaaggtgaacaaattatggtatatccatcaaggggcttttactcagcaaggaaaagtcaagaacatggatgggtctcagaaacattatgccgagttaaagaagccagacccaaaggggtgcagcatgcacaagtccatttgtgtgaaatcctagaacaggaagatgaatatatagtaacggaaagtatatcaatgtttgcacggagccaagggatgaagaggagatcgactggaaaccttttgggttgtgttatatgttctatatcttgattgaggtggtagctagccctaatctctgatttttacatgtaaggaacctgggatcaggagaagttgaatgagtcgtcaaaagtgaggttagcttattaatcagagagaagatattcacacttgattgtcagtaataaacggtttccattatgctgtatatgggtcgataggaaaagtgcttctccccaagcacttgacaaaaccctgacccggccataaacatcctcttatacaagtatgaagcgtaggtgtgaaagtataaccattctgcattccagccacctacttctacacatggttgacattctcacgtgtccctttaccctgacttgtttgtgtttatatttacaaatgaaaacataacttctcattaatattttcttctgaggaatcatactgtaatatacagttttataacctgactttgtttttctttccctttgtatcacgtggcgtgacgagtattctaccttgttgcttatagtctgccacttaaacctgaaacatttcttgcataataatacatttttttttcctgaaagatcggaaacgggaacttaagctccctactgaatccttccgcataacctgtttcatgctctgagctttctgttttggttccctgaacccatatgtcagatgattctccactggagccggggctgccctgttttactactgccgctttgtaagatacattaatagctgacatggcaaccagatgccactcactcatctcttttccttgtcatttccaggaggactaataacaacgaatgcaactaacacgtatttctccctcaataaacgccagatgttgtactacgttctcgacatagtaatagacaacttatttatagtgcttgttaggtcacgggcatttctccaggtgcttttcacgtgtttccatgtgttaactcacttaatttttacagtagcccatgaggtagaaactgttactatctttgagttagggggaaaacaagcaaaaagaacttgagtcacagcgaggtcacttagttgccttggatcatagaatttagcaccaggattgaaatcctgatggatctgaccacaaatcctaggcccataaccaataatgtgcgactctgtgtcaaggctgaaatgagcagtacgacagggcccactcaaagtctgctgggcaatgatgggtgtggtttctggaaccaatgtcccgactccagccttctgtccaagagactcatcattgcacagtgttgccctataccatctctccttttttcggactgtgtgggaactgtttctctggtgttcaacttgaagtgaagtaacagggacagacaagatgtacatggacaggaaggaaggagggttttcagaggggagcatatcgccaggatgaattcagttccctggaggcgttttcaatgtgtgtttctttgtcttctctgtactcaccctcttctttctgacccacacatccatcccttggccttttcaccctgtatgtcaggtactcatgccccttccttgccatgtctacttcattgcaagggcagtcatttctacttctccctttgacaatatcagccactctctggtcccgtcatccttctgtcccaaaggacctgtaaagcacagccgtataattatatgtatatatttagacagagagtgatatatgtaataaattcgaaaagtgaaacgtctggatcaaagtgtaagaatgacttctgaatggttaggcatattgcagaaaattagactcacacacggttagtggaagtgtatattggtgtaaatatcattgaaaatccttacgaaaatatcactttatgcttaaaagtactcatgtgcttctcctgggaaactgtagagcagggactcaaaatcttaaacccacttcgaagccctggctgtgttccactgggttttttggccacccctgctgggggtactctgtaaccctggtcaacctgtgggtattgttccattacttttgtgtacagggaactctcctactttcttattttaaaactatcagttcaaatattaaaacaccgagaggtagaaaagaaaaaaagcactaaaaagcatattctgaacaagaaacaaaatttggccatatataatacataacacatgaaaagaaatgtgcagtgggatccagtgttgtgtggcaatgtgtttaccaacatgatttggagtacatgtatctgtaacctaattgtggaagcatgtaatacgaaacactaatacttgctcgcatgggcaacacggacacacagaccacacattcttccctttctctgagacagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggaggtactcagttctatttctaaggatacattaatgaaaaaatattaatgttgcagaagaaaagattaatttgttctagttttgcagtcaggttatgaaatagttctgcagcccgaatagctctggaataaatataaatagaggtcggtagaaatggttcagatggatgtattctcaaaagtggttttgtcgatgatcccaaacctacatcaaatgcattcatttaacaaatattaattaggcccttattctatgccagacactaccagcccaaagtgactcctaatctgaaaacccatggcccaaacagattacacccatctggtccaagacagagatctccaccttatccaagacacctggttcccaccccaacaggagtgactagcacaaaacatcatcccggcctgcttacaaaaaaatctgtcgatgagacctgaaagcttgccatttaagggagaaccagtgcagtctctggaggagcactcagggtatagaggcagaccaatatacgtgaggacataattcctgttctgccacttacctggctgggaaatgtacccgacatctgttaacccaatattcatgatctgaaaagggactgtggataaaattctcatgggatttctgtgaggaggtcaagagaaacctagtgagtctgcccaacactgagcagatgttggttgccactgggcaagggttggttttcttcttatcccgttctttccctgccgtagcagggatgctgatgccatgcactcagtggcatggcagtgatgtaggcagaattccaaactaacacaggaagtaccagtaggaacacacgtgatgtcataaaggttactcaccactatgtctgtgtggggggatcagccagtacatggtgggacttgaggggaaacccaggcggtctgggtgagaagtactagctgctttataatactcttgagatcgcccgtaattctggcagcacaactgcgagacagggattgtgctgagatgccagagttcagcaagtggatgtacgcctgtgtgtgttgtgtcttcggcatctctctctgtccggtccctctgtggctttttatcacatgtgctctcttccaacacaaggccttgcctgaggctgtagctgtagctgttggctagcttacacttttacaccttcttcccctcagtgacgttatttctgaagtaatgtgtgttctcaaaaatgactctgactcttcctgtgctccatatattgaccgtgtgcccttaaccctcactttaatctttgatttttttccctttcatttatggactttcatgaaaatgagttggtttctggacatcctccaaatgtcaccaataggggtctttgttgttgttgttgctgttgttgagtattgttatggactcataactttttaacatactgatgggctccaaaccgcggttaaaggattttgagtaaaggaatgacaagatttgacttatgccttaaaaaatcactctgcctcctgtgttgaaaatagatggtaggggagtcaagggcaaaagcaggacaacttggaaggcagcataatccaggagacagatgttggtgacctggccagggtaggtagcaatggagggggtgagaagtggccagactctggatatattttaaaggtagagccaagagaagatacatccatcctgatcggttggatgtagagtgtgagagaaagagagcactccagccccacttccaagttgtagggaccaagcatcaggaatgtctaggtcagatgctctgcccacatttaatttcacttctaatggcacacagggaaagtcccagcaatcgagaggagcaggactgtcctgacagcgggtcacacacagtgaaagcaatgatgccccctacagaagttcatctgaggcctggccataatcagtatattgcagagaggtcagcagtgaccgaaattttattcataagagtgccctgagacaaggtgtacattttgaaattggtcgaggtctgtttgatggtccaggagatggtctaccttcgtgaatgctgcaagacagtagagggggaaaaaacatacatgctctgtttttgttgttgggtacagtgtgttgggtacggtgttttatttatgtcatttagatcctgttactgtagtggttttcagtatctgctgattttctttccagtaattctgtcacttgcttaggaagagttgtctcttgggctgaaagcatttcgggctgggcaaaaagaaagcttgctctgggtatttcaaactgagtatttttgagggcaaggctggaggcaggagggcagcttgggaagctgttacatcggacccacctgtcattaaagctcgtactgcactggcaaagaggtatagcttgctgattgttcacagaatgcatttggggattggatttgggaggtgcgagagagcttgtctcccaggtgttggtgtggttgttagattagagaagcctgagagaaggcaagattaggaccccttccaggtgtgtggctggtgtctagtctaacccatggacacgcgcacctctgttctttataattcctgctccatttctcaggaggttcaacacagttgcttcctctcccaagattcctaccctgattgtgccacctgtgagataaggctcttgtatctggacaggcagaggagtttgttttctggggcttatgtggcgggttggcactttgctagccctaccatggagttagctcacgacgtggtacgtggtaagtggaccattgatgtgtctcaaacttgtctttttgttctcagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacagtgagtatcttggtggggtctgcattaggtggactattctggaacctgatagaaggaagaccacttaaaacaccctaagttgattatttggaggagagcttcggaatggggggaaagggagtttagggcatctatatttggcacaaaaataagaaatcatgtcagcggtcctttctttagaaatctaagctaagtagaaggttggaaagaaagaaaaaaaaaacccagctggttggttctgttctccatccttagttccacgttgtctctcccttccctcctatttcttctttttacccttagattccttacgggataaagtatgacaaggcatggctaatgaattcaatccagagccattgcagtgaccgcttcactccggttgatgtaagagaggatggtgaagccagatgagtgggcatgggggacggggagaggcctggctcagcaggggccattggcctctgacgctgttgctcttgccttcactccctgtagttccactacgtccgaaatcgggcatgcttctttgtccaggatgctagcgctgcctccgcattgaaggatgtcagttataagatttatgatgatgagaaccaaaaggtgtgtgccgagggcatgccctgtacttagtctctgggcaggaggacaggccagggggctggtcatcctctttgggattagaggtcctggtacttaccaccctgccttcctgcagatatgtatatttgtcaatcattctactgcgccctactctgtgaagaataagttgaagccaggccaaatggagatgctaaaggtaatacagactcaaggatcattgtatgtccacttcctggacccacctcttcttcccctggccccctctttccctgtcaccacaccaccaccaccaccaccatcaccagagccccagagcctctgtcttcatctctatctctgcagctgaccatgaacaaacggtacaatgtctcccagcaagctcttgatctccagaatctccgctttgacccaggtaaggctgacagcagcaattctaagacaagcgggggcagagaggtctgcctgggagggagacttaggaatggcaatttacagaggggttggggctggctctggtccagccagggccctcccagccttccgattcccttctcttggcttcttcaagacttgatgggccgtgacattgatataatcctgaatcgaagaaactgcatggctgccaccctgaagatcattgaaagaaatttccctgaggtgaagccttaggctcagtgctggtatttagttagaggggtggaagggataaggtggagggcagatttgtctctgaggcccaagatagtagccgccactctaactcttcttgacccaaagctgttgtctttgaacttgtgcaacaacaagctgtaccagctggatggcctttctgacattacagagaaggctcccaaagtcaagaccctgaatctctccaaaaataaggtgagaagggggagccagatcaactttgggtggagggcaggacacatcaggataatggcaacagccaggcagtggcacctgtgggtgactatgagggccgggggaattcagggcccagggtcctgggtgtctctctttccctggccctccttctccagtttcctccccatctttcttagctggagtcggcgtgggagttgggcaaggtgaaagggctgaagctcgaagagctatggctagaagggaacccgttgtgcagcaccttctcggaccagtccgcctatgtaaggtcagtggcaaccccggtcacccttcctgggcacctttgctccctgggtgactgagctgtgtctgaaggtgcccttctgcaggaagaagcagccttggtcctctgggaggaccacagacctcccttcctactctctctctctctctctctctcctctctctctgtcactcactcatctgtgcttagaggtctcctttccttcctctgacatggtccccttttcacctgctctggggtgtgtttcccgcctgtctccaccaagcctcctccagtgtgccctctgtgagtgtgctccaggaagtggggctcccccacctccccaggaccagcagtattcagatgctggtgccctggaccgagaagagtcctttagtccggggcttcatgctgagacaggccttcctgcctccatgctgcgatggggcttccctcccctgtcccaagaggggttctccttctcttgctccaaaaaggtccccccacctgtcctgggctggcatgggggcttccctgccccatactgagggctggggccccgggtggctgctgtcatgccatctcttcctctggcccaatgccaggagctgggccctccttggggagaaacctgggtttcctacgtcaaggggccagaagcgggccacgttcctgaggcaggagtggaaggcagagggcagaggaggttgagaagacagaaggacaggcctctcaggcactgccccaccttccctccttctccacctcacatcgtcctgcctgggccctcagaggagccctgggtagcccgagatgggtagcattcctcggtcaaggcgtcagcacagaggggcacaggagtcagggaccatcagaagagaatgcagtggtctggagagggggtccccagactctgaaccccatgctgagctggggcctgactcttcactcctcccgggagaaggtctcctgtccccgtggctgctctgtttcccatgcccagctcagactgagctcacacaggtgaggaaggctccagctgcatccagtgggccccagcccaacaggcgcatgttttcctttcctgcctcggtccccagggccagccagggagcagtgagggaaagggctgcagcaggggagcccttttctcctcttctcctccctgaactccacctccgcagtagagagtctttcccttccctttgcattgcatcctgtttctcccttgtctctcctctcctatgtctcacccatccgtccctcccctaccttcaccccgtttctgttgttgtcccccctgccttccgcttcctgcctcctgagtccggcctcactcacctccgtgtcccagcatcctgggccatccctaagggctgacctggtcttggccagggcctggtcaggcaggttgatggacagccagtgaggtggcagagccctgggctcccaccccatttcctgctccctgcagagccttccatggtgacttgggcaaaggggagggagggagaggaagaaagccctggagcctgggctcccagtgctgcttcttgtagcactggagaaaagggagtcaggacagtctagatggaagctaaccaggaggaaggagagggaggagtgtgagagggagtgggagagagactgtgcaaccctgaactgtcagtcacttcattcaatttttggttttggacagtgccatccgggattgtttccccaagttgttacgcctggtaagtatgtataataccgtcatcattgtctcctcttactcaagaaaaggacctccacgcctgccctcaagtcctttgggtcttgcctagattacatgcttgtatcagaccctcatccattttacaggcatggattcctgaaaaagacaagaatattctccctggaaaatgtgtccccccgccgccaccccccccccacacacacatttgcatgtgatagtagagatgtccagcaccccatgagaaagccacccactggaatttccagggccatttcccacctagcctctgatgcttgtctccctgggcatgttcatcttatcgatcatccagctccatctccttggtctccactgctgacttcctctttccttctccaggacggccgagagttatccgcaccagtgattgttgacattgacagctctgagacaatgaaaccctgcaaggtgaggaagaaggaccaagcaagatttgggttgctgtaagggaggctttgtccaccgcatagatccaaattgtcttttgatttcaggaaaactttactggatctgagaccctaaagcatttagtcctgcaattcctgcagcagtgagtatccctgggaccatgaggaaggggagggctgagacaggctgggccacccgtgcagcctgggagttttcaagtctcatctggggcccaggccacagagatagcctatcctcactgcttccccacaggtattactcgatctatgactctggagatcgacagggtctcctcggtgcttaccacgatgaggcctgcttctccttggctattcccttcgaccccaaggactcagccccgtgagtatcacggctcagaccctgctctggggctgtgtgtctccccagcagacacaggccaactcctggaaatgcccacactggccggaccacccactcctgctcctctttttctcctaggagcagcttgtgcaagtactttgaggatagcaggaatatgaaaacactcaaggacccctgtaagtgtgtgatggggaagagtgggcaaggtaagggggtgtgatgggaacaatcacaggggccaaggaccaggatgtggtagccccccgccctgccccgcccaccctgccattccttgcttctcctctcctctacagacctgaagggggaactgctgaggcgcacaaaacgtgacattgtggactccctcagtgcgttgcccaaaactcagcatgacctcagctccatcctggtggacgtgtggtgccagacggtgagcacctgcttcctcccttgggcaggcccagagagccagaggtgggtaggaggttaaggaggatcctgagcacctgagcgcttccttttcaggaaaggatgctctgcttttctgtcaatggggttttcaaggaaggtgagtgtctgtatagtcccctccccagatcccccactgctccctccccctggctgggctccctctcagaactcccccagcttccctgctttcgttcctttcctttccttcctcttctttcttccgtgttttcccacccccactctgccttcaaaccaccctgatctgacctaggtccatgcctgtctgccctgcacagctcaggcgtgcgttaaggacacagactgtggagtttgacagctctcatcccaggtccttactctgtgaacttgtgctggttacttaacccttcagtttcctcatttgcaaaatggggctaataatctatctcttgggctactgtgaaataggaattaagtgaacttgtggttttcccagggccccacacatgataggggccctgtcactgggagcggattgttcctgttgctgccctccccattcctgccacatccgcctgactccaagtgaacaattgtcctggtctgccccctcccccccttctgtgtgagtgtcaagcaatactctgactggggatcaccgtgtgagcatgttaaagcctgtgcaactctaaggtggtggtgtttgttgtctttgaagtggaaggacagtctcagggttctgttctcgccttcacccggaccttcattgctacccctggcagcagttccaggttagtgctgtgttgtgggtgggagcacccatccaagcttggggccagtgttgtggaaatgtggtgggtgcagtcctccgggtgttctcaatattgtggaaggccgacaggaagatccaaggagcagtctagcctagtgtttaagagtgtgggccctggagtcagaatacagattctgttcctcactccaacactcacaaactgtgtgaccttgatcaacttattcgaccactctgtgattcagtgcctttttctgaaaattggaataagactatccacttccttgggctgttgtacagggtaaatgcgttggggttggatctaaaaatctagtgaagctggtagacagtccctccaaaggtggactctgtgggagggttagagggtaccagccaaaaaatctgggaggcaggcacagttagggatatggaaggaatttggttgttgagtggcagtggttaagaaggatcctgttgttgggggtgcggagttatctacttgtccagtttgagggtgcatttttctttcctccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgagtgctgggagtacatggggatgggggctgttgggacatcagaggaatgagtaatggaaactcacatgcaatttggaaaaataactatctgggtattttgcttccaaaaaaagtgggtccatgaaaaaggtatcatacttttatactggtatatgtaaatatttttttaaatggcataatgcccaaatgacattaccttccatttgtaaaatctgaaagaatcaaccacaataaactactgataaaccaggtcagcaaggttgaaagatacaatatacaaaaatcatttgtacttctatgtagttgcaatggacaatccaaaaaaatgaaattaagaaaataagtccatctacagtagcatcgaaaagaagaaagtatgtaggaacaaaattaagagaagaagcgcaaatcttgtactctgaaatctgcaaaacattgctgaaaaaaattaaagaagacctaaatacgtggaaaggcatcccacgttcatagattggaagacttaatatcattacgatggcagtaccacccagaacaatctacagattcattgcagtccctgacagaatcccaactgacttctttgcagaaattgacaaggtaatcccaaaattcatgtggaaatgcagtggaccccaaacagccaaaaccatcttgaaagagaagaacaacgttagaagactcacacttcccgatttcagaacttgctacaaaactacattaatcaagactgtatggtaccgacataggaacagacgtgggaatcaatggaatataattgagagtccacagataatctcacgtatttatgtccagttgattatcattcagggtgctgaaaaaatccaatggagaaaaaaaatagtcttcttaacaaatggtgctgggagaagtggatatccacttgcaaaacaattaattttgacccctaactcacatcacgtgcaaacactggcagaaaatggatcaatgacctaaaataagagccagaactgtaaaacactgtaagtgtacatcttcattaccttgaattaggcaaccatttcttacatatgaaaccaaaagcacaagcaaccaaagaaaaaataggtaaattggacttcatctaaattaaaagcttttgtgcatcagcagacactatcaagaaagcggaaaaccgactggtgggaacaagggaaaatatttgcaaatcacatcgccgacaagaagaacccttacaactcaacaacaaacagacaagccaccgaattaaaaaatggggaaatgatttgaatagatgtttctccaaaggagatatacaaatgaccaagaagcacgtgaaaatcttctcaacatcgttagtcattagggaaacgcatatcgaaaccacagtgagttaccacttcatacccactacgctagctttagtccataaaaggaaacatgacaaatgtcggtgagaatgcagagaaattggaaatctcatgtattactactgggaacataaagtggagcagttgctggcaaaaagattttggcagttcctcaaaatcttaaacatggagttaccacatgatccagtaatcccactcctaagtgtataccaaaagaaatgaaaatatatgcccattcaacaacttgcacatgaatttccgtagtggcattattccaaatagccaaaaaatggaaacacatggattgaccttcagctgatgaatggataatgtggtacatccatacggtggaatattattagaatattattcatccacaaaaaaggatgtagttgtgatatatgctatgacgtggatgaaccctgaaaacattatgtgctaagtgggagcacccagtcacaaaaagccacataattatatgattccattcatacgaagtgttcagaatagccagatccgtagagaccgaaagcagagtagtggttgccaagatctggggaagagggagaacagggagtgatctctaacagttaaggagtttctttttgaggtgataaaaacagtttggaattagataggtgtgatggttgcacaatcttgtgaatagacttaaaagcactgaattgtacaccttaaaatggtgactgctacagtatgtgcattatatctcaatagaaaagaaacgtattattgaatttccacttgttatttcttgaacatctttctttatcaatatgtattaagctcccttgttcatttgaataccgctatgtttctgatttgaattctagtgggcattaatgtcagggatgggcgttttggttttccccaggccttttttcattgttacaatagtgctcatattggtacatgtgacccagcaaaaaggtagcatagattaagggtggcattgcatagtcagcgtgtctgtcctgggctagtaatggagagcacctgttcttctcccaccccaggtgccttcaggacaatgagtggaactacactagagctggccaggccttcactatgctccaggtgaggtctgggaatcaagtgggtaaaagacagctgtctctgggtcgtcaggagggccaagaagatggaggccaggtagtgtggggatggaacccagtgcacctggctctactaacatcccaactccttttctttactttctctagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 4804 - DNA, 111351 bp, human
gacgcagaggcgaggccgccagtcgaggacgaggaggaggtgagggaccagggtcgcgagggctgtgggggataccctgctgcctgagtccaggccggcagagccccttcaggaaggtctggagcagtagctaaggagttagaaggtattccaggaccaatgaaaggtagccagagccgaggaagattcctttcctagcttggtcagtaatgtgcagtgtgccccgcttctggcgagttaattgtccatctctgggccttgttttcctcttctgcttgcccaagaccagacttctttgatttcagtaaaggaagtgccactaattccccttcccctcgaggcctgtttgaagaccctagttgttcctttgagaacctttgagccctggtacttaatcctttcaactgacggcagcgggttcagtcaccaggacacacaattgtagttgaagagcgctctttctttttgtccctgggcgagagtcaggtcttacacagcttgcctcttcttttctctccaattccagataacatcaagatgccgaagactgaggaaactgtgctccagaatgatcccagtgtagcagagaatggggcccctgagcctaaaacaccagggcagagccagaaaagcaagagtttctgtttagatgaccagtctcctggtaggtctagaatcatgtcatcacttctatggacagcaattaggctaaaggaatagacagcctgtgatttaagggcctttaagggatatagaaggctcttgcaaccttgcatttttccttactaatccttctgttagtcctcttttggattattctttctcttgtctttctgccccctctaatttttacatgcaggacttaggcccctaattggtaagtaaaattaaaagattttggttttagagaaagagaccgacaaagcaagttacttgtgtttgacaacagtcgagagtgatttagtcagttcaaagcctgggaaataaatagcattcttgtattttgattttgtaaagtgcaaatggtagatctaggacagatcgaagtgatccaaattatctgttgcttcagttgtgttctgtccttttccaggggtgctttgttgacataaaaattaccactgctctggggtaaaattatttaggtctttaataatagcatttttatgtgaacattgggactttaagtctttttcacaccttatgttaggcatttgaagctttggcttgactagtccaacctcacaggaactcaaattgcagttcttttacaataatctccagtgaatttaaccaaaggttaatctgcagacctctccagatgtagcaatttgatccaacctcttgaacactgaaacggggaaaaaatatgaagttgaattacgtgtgtttctctggtggccacttggggtcactgctagtaagcagaatggcacaattcatacttcataatatctctcaaagaaatgatgtcttaatgaattaattagatggtatattttaacatatgtagctttttagttagtatagaagggaaataccagttgatggaccaacttttcaacagaagtcttatcaacggttttttaaatgaaaaataaatgggcataaatggaccatcttcttggagtgagctttaggattcttatatgtgagttttattatatcttaaggataaatcgttctctctgaccaagttatgaaactacattaaaattgagttacaaaatagttttattgcatattttattttacatatcaagtaataattgtgactactatatatactttgttttactactgaaagtactctgtatgatgaatttagaacactggttcccaaattcgaatgctgggctaggacatagttcttaccaatattgaatgaaataaaacaataaagaggttgtaatgagtttttaaaataatattaaattgattcaatttaaaagagtactcttaatgctgactgtgttttctttatactttctgaggtgttaaaatatgttttctttttatgaagtgattattttgatgatggtagggtagtttcattgtttgcttgtttgctttcatgtccatatgtggaaaaataaaaattgtcaaatcattatctgtcactcatgttgttttgaagtgttgtctgttgaatacccagatttggaaactactgttttaggagcaggtttcagctttagagccatctagtaagattcgtgtggtatctataaggagattttagccttcatcttgtgtgtagcccctgaggtaggaagagaacagtgggaacacaataacttttagatacacattaattttacaaatcacaacttattcattgtttgctgtgttttgcttatggttttacatttcaagtggaaggttttcaaaactgttttatgtttttcaaaaactaatttcttcctcccatgcctgacttctctgagatgttcagtgttactgaagagcaaagagttcagaaaacttctggtggtaaaatgattgaataagtctgtgtaagatccgtttgatgaatctaaacttgggagccttacttggcagagtgaatctctaaataaaataaaaattctctttgtgtgggttccctgttgatgatggctatgctttttttctttctttttccggaaagcagacctgatgtcttttctgtcacagatctgatagagacagttaatgaagtttccaagctgagcatttcacatgaaattgtagtaaaccaagatttctatgtggaagagaccattttgcctccaaacaggtacagattattcagtttttttccattttactcttcggggcataggtacatagcacagatgacttttggtcagacttgaagcatcttattaataaatttaatggttgagtgtgtcttatatagtaccgacaaattagtgtaagtattactttaaaagtgtcaaagcagcaaattatatttaaacaggtaataaaccaatgcagttacaggttgaacatcccaaatcggaaatccacgatgctccaaaatccaaaacattttgagcgccaacatgatgctcaaaggaaatgctcattgcggtatacaagtatgctgcaaatattccaaaatccaagaaatccgtaatctggctaggcgcagtgtctcacgactgttaagttccaacactttgggaggccgaggcaggtggattgcttgagtccaggaagtcaaggccagcctgggcaacatggcgaaaccttgtctatgcaaaaaatacaaaaattagccgggcatggtggtgcatgcctgtagtcccagctactcaggaggctgaggtgggaggatcccttgagcctgggaagcagaggttgcagtgaactgagatcgcgaacacgccactgcactccagtctgggcgacagagtgagaccctgtctcaaataataataataacaataataatccgtaatccaaaatactcccgtcccaaacatcttggaaaaggggtattcattctgtattgtcaaaatgttcatttcaggatcttagttaataatgaaacgtagagtgattttcagatcttttcagacagacttggaagaggtaactcctagccgttcaacttttaattatctgcagattaaacaggcagagatgagcagattttctaatagtggttttgttcactcttcaggagtaggaaatttcaggggacacttctgcttcataatcagtgtaataaagattctgtgaatcaagattagaaccccatcgataaatagtgtgcttctacaattaggctttatattggtttctcttaattatattgatataacaatatatgattaagaatcatccagcatttatggattgaatgcttctagtgtttattaagagttaaatgggttgatttctttgtcagaatctatattttacggtatttctaatttcccaccttaaatgcttctgttattttgccacttttgggattctgttacgtaaagccccttgctttgtcagtggttctcttgatcttcatacttcttagattttcctttgtctgttgccaaggatgggttacctgaaggaagtttttaccaaaacacaggtctcgtagcatctccctcattgcctttatagtccctgcggcccgagttagatttgtttttctcctggtaggggtgcagaaaaaagtgaagctaagagaatgaaggtctgttaaagtggctagggatctcagggggtggatagatgaagcaggaggaataatattatttagggcttggatttcactgtgttttttaaattaacaggctttttcaaatgtagtaatacaaaatgtatactggataagaggttgaaatagagtttggggttatccattatctacagataattgacagttttccctttggacttataaaattatactaagcacagttatcggtttttaggggaaatctcataataagacatttattcaacaaacatttattgagtacttattaggtggaaggcagaatgttgaaagctgaagacatatagttgagtgagtcactgtctttgccatcaaaaagcttctgtagggaagatagtcaaatagctactgtgcagagtgataagttatctcatatctagtgtgtggagttctatgcagtgctcagctacctggggaaggtcagcgaagactttcctaataaggtaacacttgaattgagtcttttcaggtggtttaggggagaagggactctcctggaagaggaaatgtcatttcagagccatagagggatggaagacaattatatattaattataagtggactgtgattgttagagcacaggatgtaggaggagaaagaaggttaaggtaggagaagtggcagaataggatcgtgaagggacttaaaggccacgtacactgctagagataggtagcgtctgaagaactttaaatgagtatactattatgatcagatttgtatcttagaaaactcattgatttttatcaaaaatatgtaccattgttggggtaaggttttgtgggtgtaaggtggccatttaatagactatagcaatagttcaggaaagagatgacagtgggtgggggccgattccagagatatttaggaagcaaaatctctggaattgggtgactgagtggataaaggacatgaggggaaaggaattaagaaggactacagtacacaccagatagataatagttgaactttcacaggttagattgttgtgttggaggagaaactttgaatttttgtttcatatattttttaatcacttgtatttttgtaaacagaaaacatacattactattatatacatacacgtatatatacacacgtgtgtgtatatatgtgtgtgtgtgtatatacatatatatatatatatatatatattttttttttttttttttttttttttttttttttttgagaccgagtctcgctctgtcaccaggctggagtgcagtggcactatttcggctcactgcaaactctgcttcccgggtttaagcaattctcctgcctcaacctccggagtagctgggactataggcacccgccaccacgcccagctaattgttgtgtttttagtagagacggggtttcaccatgttggccaggatggtctcaaactcctgacctcgtgatccgcccgcatcgacctcccaaaatgctgggattacaggcgtgagccaccgcgcccggcctactattatatttttttaaagagaaaaagtctcagatttctggttacagaactaagtatacatgaggaacaaatttaaagaaggaagataaggagttcagttttgggcttgctgaatttaaagtgtctcagaagaccttcaggtattatcaagaggtaaaatcctttcctagatttcaggcctgaaggaaaaatagcatctggttcaaagttttaagtctatggcagtggaaactaagtcacacatccaggctaggtgcagaactagggttagaagtcagagtctcaactcctagtttatggttcttcctgctgcaggaagagagtgtctctggaaccttgaggtacccttctgagagaatttagccaatgcttttccatctgagactaccttcagtttattcagcccttctcaagtctaaacataggtcctcctagcctgtcaagttaatggtctttcataattttaaatgctgtttgggaaattatgatcctgtatcaattttctaggtaaaagagcaatctgctcatttaacccttcttatagtgtagaaggcaggtttgcggaggcaatgtacaatgctttttggaaccatctgaaagaacagctattgagtactcctcctgacttcacttgtgcccttgaacttctaaaagatgttaaggaggtgagtaaccaactcccattcgtggatgggaagttcctgggcatctcagaaccttggatcgtcaatggctgttaatatatcaagtagcatactttttttaacgtgacctactacttaaatagataggatggggcagcttccattttatttgtataagatgaaacttgaccattgggcgatgactataacaatatataactcaattaaacaaattcttactgaaaccccactatggtctatgtgtttcagaatcccggagatgaataggcgagcccttgcccacaaggaacttgcatgcttgagtcaaaaggctatttcaagggaaccttaaagattccagatttgctattttatcctcacactttggagtaaaacaatctaaaaatatccttatcctttattaagaatgcctcatctccttgtggtggtgtgtatttcatatttcttatatcccacacatttaaaaccacattcttatttttattcatatttttacctcattctacctaaaaaatagtaatgactactactataactgatcccagtgaagccttgaatggtaattgtcctctagacagaaagaaataatactctctaagaaatgtagagactcagttctctgcccccccagaagacataatctgggatgcctttggcctaagagcatagttcattggagaaagtttgaggttctgaacagaacttggctcctttgatttcctttgttgggcagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggtgagagtctagatgtgctgtcccccaaatctgccttagacactgtgccggagaactctgagccagccactgtggatatagcccctgtcttatctaactcttgtgtactgatgacctgactaacacaccttttctcctttctggattattggcttttattttccaaggacagtctctcggggttccttttgatgatctttagatcagttgggtctcctttatgtcatgatactgttaagacattaagttacagtaattctttctcctatagattgcaaattgccttttcccagatgttgtcctgtttgtcccaactcagaccttgtgaggggacaggaaagaggattatccgtgtttcacagctagaagaaccaggacccggaaaagtaaaatgatctgctcaatgagttagaaattcagtcacccacatcccagctacccacatataattgttaacaccttggtgattttcctttcactgactacccttttttcaaggtgacagactgactacaggcaaaagagctctcatctggttgttaaagtgtcaggaggtataactgtccttagttttgccatcaactcactctatggccttgggtcactggccacagtaccattattcataagttgaaataggactgtttgtttttaaggcttcttctgactctcaaatactctgcttttatggctccttgcttggattccacccttccagactagatttcctttaatagtgtaaatgttctgtttctccctacggcaggggcatcctccgtgttctgggcctaatgaaaatggacatggtgaactataccatccagagctttcgaccctacctgcaggaacattccatccagtatgaacaagctaaattccaggaactccttgataaacagcccagtatgtttaaaattcaagggcaggagaggggagatttgacctcaggtctgccttcttatagcaatagaggctattttctattttttgaatagaaagtttcttccttgggcaaggggtagggagaaggaatgtttctctaagatagaaagatctacaaaatcacttctttatagaccaagagtatgtctcagagccatcatctttaagccttggaattttaagatgcatattcccttctcgtcgtaggtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagaggtagggatgtgtgtttgggcattgccttgttctatggtattcagtgcctccattcaaaccctcctcttctgatgggctgtccttcgctccctcaccagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggtaagattcatagatctctgttagagagggaaatgtgtggtatttgggacataggtaatatcaatactattattgcttattcttcatcacaaaccacacaaaggcccttggaaatgatcttcaaagattttggtatctttgataatttgtattgaggtttgggatacagaaaataaaacttattttccaaagaggagagtgtggaagccagtttgctacaaatattccttatgtgtttgctaaaaatcagtcattatatacgtgattgaatgacagtggatttgtgctatgtatatctagaagttgatcggttggtcagtgatattgaccattcactgcatgtgggggcagggatattataccaaagtacaaggaggagtaggaagtccaagcctcttaatatattagcaatttaattggtggggtaggagaaaaaccatgaaaaatatccaatagagtcttaaaacaacatttaaatacagttgatgggactggagaatgccgagtagatccaaggatggaactgaacccttgcccaatttactttgttttcatcgaagtggcatatggtgctgtgtgtttggatcaggtggtaccttgcgggtaacaatgagtgtatttcatctgcccagtggctaatgctgtcttctggtggcagagagccagaattcttcctggaataggcctggcttgtggtatgaggctctctgggctttgcccctctgccaggcccactctgcattctatcccttattatctaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggtaagaatctccatggtcgtcgtgcagaaaagtggcaagaatgtggggcatgggtgggtagaccttaccctgaatgtgagttacctaagcatttaaaaatgaaaaggcatgatcatttgggaagttttttagctttagtttcctcgtctataatgtgcactgttcaaatagatctttctcaatttggagaatgcatgtatggtttgaagacagctctgtacccaagatatgtcattcacaggtgttggatattatcacgctaaccctatgaagtcattcctggtattttctcttttcttttcttttcttttttttgagacaaagtctcactctgttgcccaagttggagtgcagtgacacgatctaggctcactgcaacctccaccttctgagttcaagcgattctactgcctcagcctcccgagtagctgggactacaggcacgcgccaccatgcctggctatttttttttgtatttttagtagagatggggtttcaccatgttggccaggctggtctcgaactcctgacctcgtgatccgcctgcctcggactcccaaagtgctgggattacatacgtgagccaccacgcccagcccattcctgggtcatattctaaatgtcggccaagatatatggaggaaccctttctctatcctatgctttaagctaccatttgggcccctacgcctctccatggaagtgatgctgagttgggctgtaggacatgttccatgctggaatggaagcagtgaacttggccagcttgctttgaactttaccatctgatcatagcctggattgggtgtatgggcctgaacttggtgcactggctgcaacatgtgttgttactttcaggtaccgggtctacggtcctcttgttaagttaaacgtgccctaggatctcacatacagctacataaagtaatcttatgaacccccagaaatttactacctcagcatcttttgatcatgcattgtcctttgggagattgatggcattccattcccccaaacaaacaaaaatctcatgtatacggtttacccaaatgagcagagaggtcagtgaataactcggttaatgcaaaactttggtgagcagatagagcaaaggcattgtgaatttcttctgtaccgtcttcgttcctcttgtcattgtttttccctgctcacagatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaagaaaatttcagttcctcctgtgttctagctgaagtcaggttctgcagcctcatcccctaactagctgagtgagaatccagtgggccctctgttttcccttcattggctgatcattcttcagtatgcttgcctgagccgaatctgggcatcaggtactgataagggaaaatcctgggactgtatagaataatgccccctgaaaactgggaaggagctaagagaccaaagaatgacccggacaagtccggcttgataagcagatgaatttcttgggacttacgtatagggcattcctgggtggcagcaggacagctctggggatctgccctgacactcctctgcaagctgcttttaagctaattttctggctctttgccttctgtatgcaatgagactctttctcttggtatgtttcccagtacactctgggatgttttggttctcacagacacctcggctcctaagctgggcaccatgcatggccttagaccaccacctggccttcagggttcaggcagcagacatacagccttaagtaatctggtgggggaggggggaactcattaacctacagtcactagcattattttctccattgaaaaatcatttccttgagggctttgaaaactctttgtgagattatccagagaatgactataagggcttctggaagtcagaaattcactgaattgcagatgaagagaagacatagaactccatttctagcaccacatttccctgtagttttcaaggatacagcaatagcaagagttgcgaactcccgttctagtgtctggtttgaagcagtatgaaaactggggattggttgaaagttgatatggtgaatatcaactttgtgccaacaggcattcagctaaggacaggtctcagcttccaagggatttctttcttttaagtgattctaggggtcaggcttggaatctctgataatgacagtaaaccgaagcaattaggtcagtgagtatcatatcaagttcaccccgatcctatttctacagctgaattaatcttatctggccacatctctaggcttagaacatctccttcttcttgacagaatcgatgtgcgtattcaagcgtggggcagctgccatgctttttcccactcctagtctgggactccaactgccaagttatgaatatcagctgacttggcaacacaaatgatagatgttcttggtccacaaggacttgggcttgttgttagagactgcagaggttcgtcccatcgttcccaggccaactgcagcagacaagcagcaatctagaaaattaggaacaaatttaggtttggatttggactaggtttggattcagaatggacaggggacaatagaaacttacttatgggatagacccaaactggttgaaaaaaatcatgtcctcattatttcggcggatggaaggagctgagtacaatttactcagcccaagaaaaacaacagatgagattggagttccattactccccagggaaccacgtgattgatttccctagagggtggataccagatgggtgacatagctgggtaaacagagtgctacttttactttggctggagatgaggcacacagaaaagctgtggaatggatcattcacgtgttctaatcttgtgactagatagtctcaggacagagaccatggcagatgaatgttttataattaataaataggcagtgagcctggcctagttaaattttctaatgtgattagacaatacgaatacaattttttaaaaaagtattaattttgggagccagattatcttacagacaagtgtgttctgaagtgatccctgtgaagatgacggagtagttgacggatactgactttgggctgcaatgaaactttgctttatactttataattaaaatctgacttgtgttgatttcttggagattttgagtttattgattctcttgtgcttctacgtggaggaaatgggaatcctgatcctaaacaaggaaagatagctcactcaattctgttcaccatttagggatggatggatgcacagttagatagataggtggaacatgcacatggttaaaaatgacatgcagtacagagaaaattcggttttttcgccacccctgtatctcatttatcctacttagaggaaactatatccaggtttttgtgcatacttctaaagatattctgtgcatatgcaagtacatattataattataacaaatatttgtgagtgtgtatgcaccaggcactcttttaagcactctacatatattatttcaattattccttaacaatttatctccagtctacttttccaattctagaacaatgttgtacagaaagctctaactgagggtaagaaccggtgtttgtttgtttgtttatatatttatttatctggtcttctttgagtgagtaagggaaaatcatttcactttcttgggctttgtcttcatctataaaattctatacttgactaaattactgattttcttgttcaattttatagagtcatttttcacaaaacgaaatctttccagaagatcacgaataagagagatcaaagctaggcagcttgagttgaagtagagctggaagaaggagttttgaggactgtttcaaaaccactggactagatgatctctaaaggttcctgtattattttcttcttttcttatggctgttgtaacaaattaccccctgaactttgtggcttaaaataacatgcatgtattctcttatcatcctgattgtcagaagaccaaaatcagtttcagtgggtgaaaatcagggagtcagtagggccaggctccctctggaagctctaagggagaatccattgccttgccatttttagcttctgaagctgtattctttattccttggcaaggcaatggattcttccctggagcttccagagctcccattcctttatcatcgaagccagcatcatagcttcttgtgtcagtcatcacattgcctccttctatgtgaaatgtccctctccttccctcttaataaggaaacgctcttacatttagggccaggcaggataatctccccacctcaagatccttagtcacatttgtaaagtcccttttgccatataaggtggcagtcaggggttccagagactacaacatggatatctttggaggccattatttagcttaccacagcctaccctctaactccccaaaattcatgttcattctacatgcaaaatatatttgcctcacctcaatatccccaaaagtcttaacaccaacgcgagttgaaaatctcatctgtaaatcatctaaaccaggtatgagacagactctgggtatgatccttcttgaggctaaatttcttttcatcagtggccctgcgaactagaaaataaagttacctcttttttattacagtggtgacatggacataggataatggttatagacagtccccctcccaacgggaaaaaatgaaagcaagcaaaaagttaccagctccaagccaacttgaaatccaatcaggtaaactcatttaggtttcaaggcctgggaatattcctccgtggctagaggctctgccctctatgcccgaggctccaccctttaagtgaacagagccaggctctgtcctcagagttatcttgtttttgtttttgttttgaagagtaatacatgtttgcagcagaatactttattattattactattattatactttaagttttagggtacatgtggacaatgtgcaggttagttacacatgcatacatgtgccatgctggtgtgctgcacccattaactcgtcacttagcattaggtatatctcctacagctacccctcccccctttccccaccccacaacagtccccagagtgtgatgttccccttcctgtgtccatgtgttctcattgttcaattcccacctatgagcgagaatatgcggtgtttggttttttgttcttgcgatagtttactgagaatgatgatttccgatttcatccatgtccctacaaaggacatgaactcatccttttttatgactgcatagtattctatggtgtatatgtgccacattttcttaatccagtctatcattgttggacgtttgggttggttccaagtctttgctattgtgaatagtgccgcaataaacatacgtgtgcatgtgtctttatagcagcatgatttataatcttttgggtatatacccagtaatgggatggctgagtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgttttttggctgcataaatgtcttcctttgagaagtgcctgttcatgtccttcgcccactttttgatgggatcgtttgtttttttcttgtaaatttgtttgagttcattgtagattctggatattagccctttgtcagatgagtaggttgcgaaaattttctcccattttgtaggttgcctgttcactctgatggtggtttcttttgctgtgcagaagctctttagtttgattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctgcatagggctagccagttttcccagcaccatttattaaatagggaatcctttccccatttcttgtttttgtcaggtttgtcaaacatcagatggttgtagatatgtggcattatttctgagggctctgtttggttccattcgtctatatcccttttttggtaccggtaccatgctgttttggttactgtagccttgtagtatagtttgaagtcaggtagagtgatgcctccagctttgttcttttggcttaggactgacgtggcaatgcgggctcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagcagtttgtagttctccttgaagaggtccttcacgtcccttgtaagttggattcccaggtattttattctctttgaagcaattgtgaatgggagttcactcatgatttggctctctgtttgtctgttattggtgtataagaatgcttgtgatatttgcacattgattttgtatcctgagactttgctgaagttgcttctcagtttaaggagattttgggctgagacgatggggttttctagatatacaatcatgtcatctgcaaacagggacaatttgacttcctcttttcctaattgaataccctttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcttgaagggttgttgaattttgtcaaaggccttttctgcatctattgagataatcatggggtttttgtctttggctctgtttatatgctggattacgtttattgatttgtgtatgttgaaccagccttgcatcccagggatgaagcccacttgatcatggtggataagctttttgatgtgttgctggattcggtttgccagtattttattgaggatttttgcatcaatgttcatcaaggatattggtctaaaactctcttttttggctgtgtctctgcccggctttggtatcaggatgatgctgtcctcataaaatgaactagggaggattccctctttttctattgattgggatagtttcagaaggaatggtaccagctcctccttctacctctggtagaattcggctgtgaatccatctggtcctggactttttttggttggtaagctattgattactgcctcaatttcagagcctgttattggtctattcagagattcaacttcttcccggtttagtcttgggagggtgtatgtgtcgaggaatttatccatttcttctagatttactagtttatttgtgtagaggtgtttatagtattctctgatggtagtttgtatttctgtgggatcggtggtgatatcccctttgtcattttttattgcttctatttgattcttctctcttttcttctttattagtcttgctagcggtctatcaattttgttgatcctttcaaaaaaacagctcctggattcattgattttttgaagggtttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaattcgcctctacacactgctttgaatgtgtcccagagattctggtatgttgtgtctttgttctcattggtttcaaagaacatctctatttctgccttcatttcgttatgtacccagtagtcattcaggagcaggttgttcagtttccacgtagttgaacggttttgagtgagtttcttaatcctgagttctagtttgattgcactgtggtctgagagacagtttgttagaatttccgttcctttgcgtttgctgaggagtgctttacttccaactgtgtggtcaattttggaataggtgtggtgtggtgctgagaagaatgtatattctgttgatttggggtggagagttctgtagatgtctgttaggtccacttggtgcagagctgaattcagttcctggatatccttgtgaactttctgtcttgttgatctgtctaatgttgacagtggggtgttaaagtctcccattattattgtgtgggagtctaattctctttgtaggtcactcaggacttgctttatgaatctgggtgctcctgtattgggtgcatatatatttaggatagttagttcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctatatccagtttgccagtctgtgccttttagttggagcatttagcccatttacgtttaaggttagtattgttatgtgtgaatgtgatcctgtcattatgatgttagctggttattttgctcgtcagttgatgcagtttcttcctagcctggatggtctttacaatttggcatgtttttgcagtggctggtaccggttgttcctttccatgtttagtgcttccttcaggagctcttttagggcaggcctggtgctcacaaaatctctcagcatttggttgtctgtaaagtattttatttctccttcacttatgaagcttagtttggctggatatgacattctgggttgaaaattcttttctttaagaatgttgaatattggctcccactctcttctggcttgtagagtttctgccgggagatccgctgttagtctgatgggcttccctttgtgggtaacccgacctttctctctggctgcccttaacattttttccttcatttcaacgttggtgaatctgacaattatgtgtcttggagttgctcttctctaggaatatctttgtggcattctctgtatttcctgaatttgaatgttggtctgccttgctagattggggaagttctcctggataagtcctgcagagtgttttccaacttgtttccattctccccgtcactttcaggtgcaccaatcagatgtagatttggtcttttcacatagtcccatgtttcttggaggctttgttcgtttcttttttttcttttttctctaaacttctcttcacgcttcatatgattcatttcatcttccattgctgataccctttcttccagttgattgcatcggttactgagccttgtgcattcgttacgtagttctcgtgccatggttttcagctccatcaggtcctttaaggacttctctgcattgattattctagttatccattcgtctaattttttttcaaagtttctaacttctttgccagtggtttgaacttcctcctgcagctcggagtagtttgatcatctgaagccttcctctctcaactcatcaaagtcattctccgtccagctttgttctgttgctggtgaggagctgcgttcctttggaggaggagaggcactctgatttttcgagtttccagtttttctgctctgttttttccccatctttgtggttttatctacctttggtctttgatgatggtgacgtacagatgggtttttggtgtggatgtcctttctgtttgttagttttccttctaacagccaggaccctcagctgcaggtgtgttggagtctactggaggtccactccaaaccctgtttgcctgggtatcagcagcagtggctgcagaacagcagatattggtgaactgcagatgctgctgcctgatcgtacctctggaagttttgtgtcagaggagtacctggccgtgtgaggtgtcagtccgccccgactggggggtgcctcccagttaggctactcgggggtcagggacccacttgaggaggcagtctgcctgttctcaggtctccagctgcgtgccgggagaaccactactctcttcaaagctgtcagacggggacatttaagactgcagaagttattgctgtcttttgtttgtctgtgccctgcccccagaggtggagcctacagaggcaggcaggcctcctggagctctggtgggctccccccaagtcgagcttcctggccgctttgtttacctactcaagcctgagcaatggcgggcacccctcccccagcctcgctgccgccttgcagtttgatctcagactgctgtgctagcaatgagtgaggctccgtgggcataggaccctctgagccaggtgcgggatataatctcctggtgtgctgtttgtgaagcctgttggaaaagtgcagtattagggtgggagtgaccctattttccaggtgccctctgtcacccctttctttgactaggaaagggaattccctgaccccttgcacttcccgggtgaggcgatgcctctccctgctttggctcatgcacggtgcactgcacccactgtcctgcacccactgtccgacactcccctgtgagatgaacccggtacctcagttggaaatgcagaaatcacccgccttctgcgtcgctcacgctgggaggtgtagactggagctgttcctattcggccatcttggctccacccagtttttaatatttaacttcaccactgagtcagaactgaaacagttggtacggaggcctgtgttagtgagactttggcttgccacaaaaccaccctaattgaagaaatgaaaatctgatgtccaagtaagtaatgaagccaatttgaataaagttatttatgtgattgcaaattttaaaaagaacctacgaacgaatacttaaaaaaaaatttaaggtagtgctgtgctttgaatatgtccttcaaagttcatgtgttggatactcaattgctgttgtaacaatgttgagagttaggacctttcagaacagattaggtcatgagggctctgcctcatgaatggattaatgctgttattgtgagactgtgttagttatcatggcagtgggctcctgataaaaggctaagtccaaaccccattttctctttgtctcacacactctatcaccatgtgacaccttcaatgtaccctgccagatactggtgccatgctcttgagacttcccagccgccagaacagtgagccaaataaaattgtcttctttataaattgcctagcctgtgcattctgttatagcagtagaaaacagactatggcaggtaggtagacatattacccaaagagaaacacatctgaaaaatatacaccaatctttttacattgaatatgtatgcatcacagtgatgggatcatatagatggaagatgtagaatgatttcatcttctaaatatacatttataatgtttagtattttttaattaggaaaatttcttgagagaaacacttgaaaatatgtaacagcaaattaacaagaaaacacataaatatttttattttaagaagcgttcatgctatgctgtttttttttaaaagaaagattataataactcttgacttgagagttacccctatctgtgtaggtgtgtgatttgtatattacagttccatcatttagaatgttcaaactctcaatgtgcagacttatcttctgctctctcaggggttggatgtcctctctcagggcatagagacacaataagggattgctgttaagggatggacaattatagaaatttctggttgatgcactgcatatcagtcccttttatcactcccttccccttgcaagctgatctgtcctgagacttttggggttataagtctgactctgacaaacaaatagcatctttgtacattcaatactttaaaaggaaaaggtgtgattctttttttctactcccattccagtggccactaaattatctttcctatttcctttatactttccatgtctgtctctaatatgccctctctgagatggactgcactttttttttctgtcattcagttattttcagatatttttgataactttgtccttccttaagaatatgtgatgcgcaagagtttattaaaactatgtgtggtgaaatcatgcccatccagtagagctcagttctaatgctggcaatttcatgtagcatctgaatgaaccctgacaagcttctacaactcattaagtctcagcaacctaagacaggccaagaagctggtaattctgcctaccagaatcccgttatgaggaacacatggaggaagaaaatgtaatgtaatgcagcaagcacagagcatggcatgcagcaggccctcagagttcccccatgtccgtagctacgagtacctgggttccgggtctcccgactatagttagcttgctctgcaggggtgactcaattggaaacagctccctgggtgttggtggcaaactcagggggcactaagaacaggaagtagagtctcttctggctcccagggctctcctcactatgcccttcgggaaaggacttattttgaaaactccaccttgctcacgtgagcctgacaaaatggtctgaggcctactcttgcctcgtttgacagatcccctcaattttctctgaaccccagctccagatctcacagattctcctcacaaacaccatgtgaagacagtggtgacaggtcactacccacatgccacaccatgggtgaattggtcagtgccaatccttggcctcaggatctcacagggcatgaagggttctgggccccctctcccactccaacccccaggacacccagcagactcactttcagttagagctggtaggtggcaagggcccaggctgagtgttttccattgtcctgaggatgagggcaaagtgaaccctgagatacctgtcttagtccattttgtgctgttataagagaacactcaacactgggtgtgttagtctgttctcacactgctgtaaaaatactgcctgagactcggtaatttataaacagaaaaggttcaattgactcacagttccacatggctggggagggctcaggaaacttacaatcatgggagaaggcgaaggggaagcaaggcttgtctttcatgatggcaggcgagagagagagcgaggaagcgccacactttaaaaccatcagctctcgcgggaactccatcactatcgtgagaacagcacggggaaaaccgcccccatgatccagtcacctcccaccaggtccctccctccacacgtgaggattacaattcaacatgagacttgggtggggacacagagccaaactgtatcactgggtggtttataaagaacagcaatttgtatcttacagttctggaggctgggaagtgcaaggtgggggggcttgcatctgatgagagccttcttgctgtgtcatccaatggcagaaggtgggagggctagagtgcacaagagagagaaagcaagagatcaaactcatagactcaagcccttttataattggtattaatccattcctcaaggtgcaaccctcatatgacctaaacacctcccattaggagggagggttgcactggggattaagtttccaacacatgcttttttggggacacattcaaaccaaccattgcatcctgcccctggccccccaaatttatgtccttctcacatgcaaaatacattaattccatcccagtagccccaaagtcttaactcactccagcacccaaagtccagagtctcatctaaattagagatgggtgagactcaaggcaggatccagactgaggaaaatttcctctagctctgagtctgtgaaatcaaaacaagttgtctattcccaaaatacagtggcgggacaggcgtaggatagacattctcattccaagagggagagacaggcaacagaaaaggcataactgatcctaagaaagtccaaaacccatcagagcaaacaacattaaattttgaggcttgagaataatgttcaagttctgccttctgaggcagggattgggcccccagattctcaggcagccatgcctctatggctttgctaggctcagtccacccagcagctctcacaggttggagtcttgttcctccagctctcccagggtatcattaaatgccagtagctctgaaattctggaatcttagtagcagtccagctcccacacctctactagacattacccgaattgggactctctgcaactgacttgttcccacagccccatcaggtactggcctgatggggactctctctggcagctctgcccctgtggcaggtctctacatgggtcctcaggctgtctgcaacattctgcgaaatctaggtggaggccgtcacagacccatagctcgtgaatgctgtgcacctgcagaatcagcaccatttggatgccgccaaggtccaccgcttgagccttccagaccggcagcctgttcagcacccggccccccttgaactatggctgggacagccgaggagtgctgcacgaaggtgcgggcagcagacacttaaaagcatcacggggcagcagatgttgaggtcccgtgggcgtctctctggaaactttgccttcgcattgtgcactgggcatgtgactggaggagcagcctggaaaactctgaaatgccgtcagggcctttctccagtggtctttgtcttactgaatagcacctgtttcccttctagccatggtaatctcattagcaaagtggtcacttggccatgtctgtagtttgcactcctaaacacgctttttcattctttacatggctagggtgaaatttttcaacatatttaccttcttcctatcttttaattgacaaattccatctttaaagcatttctctcttctctcatttttgtctaagtggccgaacaaagtcacgcagtaccttgaatgttttgctgtttagttatttttactgccagatatcctagttcattaccctgaagttcttttaatttttttcatttttccatttttgtgggtacatagtaggtgtatatatttatggggtatatgagatatgttggaacaggcatgcggtgtgtactaatcacatcacatcccctcaagcatttgtcatgtgtgttacaaacaatctgtatcctcttaggtactttaaaatgtacaattcaactattactgactttaggcaacatgctgtgatatcccaccttattcattctttctgtatttttttgcatccattaaccatccccacctaccccctgcctccacactacccttcccagcctctggtaaccatccttctactctctatgtccacgagatcaatcgttttgattctcaggtcctacaaatcagtgagaacatgcgatgtttgtctatctgtgcctggcttatttcactcaacataaagatctccaattctatccacgttgttgcagatgactggatctcattctttttacgactgaatagtactccattgggtatatgtagcacattttctttatccactcatctgttgatggacacttaggttgcttccacatgttgctattgtaaacagtgctgcaacaaacaggagtgcagatatctcttccatatgctgatttcctttcttttgggtatatacttggcagttggattggtggatcatgtggtagctcaaattttagttttctgaggaacctgcagagtgttctccataatcgttgtactaatttcattcccaccaacagtgtacgagggttcccttttctccacaccctcatcagcatttgttattgcctgtcttttggatataagccattttaactggggtgagaagatatctcattgtggctctaaagatcagtgatattgagcacctcttcatctgcctgtttgccatttgtacgtcttcttttgagaaatgtgtattcaaatcttttgcccattctctaaccggattattagattttctccaatagagttgtttgagctccttgtatattttactggttattaatcccttctcagatgggtagcttgcaaatattttttcccattttgtgggttgtgtcttcactttagtggttgtttcctttgctgtgcagaagctttttaactagtcatgcatgatcccatttgtccatttttgctttggatgccagtgcttctcgggtattactcgagaaatttttgcccagaacagtatcctggagcgtttccccggtgttttcttgtagaagtttcataggctgacatctcagatttacgtctttaatccattctgatttgatttttatataagatgagagataagggtcaagtttcattcttctccatagggatacccagttttcccagcaccagcgccatttattgaagagactgtcctttttccagtgtatgttcttggcacctttgtcaaaaatgagttcactgtaggtgtgtggatttgttcctgggttgcctattctgtcccattggtctatgggtctgttttaatgtcagtaccttgctgatttggttactatagctctgtagtataatttgaagtcaggtaatgtgattcctccagtgttgttcgtttttgctcaggatagctttggctattctgggccttttgtggtactatatgcattttaggattgcttttcctatttctgtaaagaatgtcactggtgtttttgtagggattgcatcaaatctgtggattgctttgggtatgatggacatttaaacaatattgattcttccaacgcatgaacatggaataactttccattattgtgtcctcttcgatttatttcatgaatgtcttccagttttcattgtggagatctttcacttctttggttaattccgaggtatttaattttatttgtgtctactgtaagtgagattaattttgatttctttttcagggtgttcactattggcatatataaatgctagtgatttttgtaggttgattttgtatcctgcaactttactaaattggttgatcagttctaatagttttctggtggagtcttaaggtttttctaaatataagatcgtatcatcagcaaacaaaggtaatttggcttcttcctttccagtgtggatgctctttacttctttctcttacctgattgcttgagcaaagacttcccgtactatgttgaataacagtggtgaatgtgggcatccttgtcatgttccagatcttagaggaaaggctttcactttttccccattcagtatgatactagctgtcagtctgttgtatatgacttttattatgttgaggtatgttccttccatacccagtttgttgaggaattttatcaggaaggaatgttggatttttatcaaatgctttttcagcatcagttgaaataatcatatggtttttatctttcattctgttgatgtgatgtgtcacattgattgagttgcatatgttgaaccatcctcgcatcccagggataaatcccacttggtcatgatgaacgatctttctgatgtattgttgagttgggtttgctagtatttagtggaggatttttgcatcgatattcatcagagatattggcctgtattaagaagtcactgtaagaagatgcctgagagtggatacttggtcagtgtaatgattttaatatgcgccttttctattcttcagaaaatagtctcctttcttatttactttagaatgtcatgacccccaacctatggaattaattaaacaagaaacatttccaatacactatttcacattcagaaggtttcacagtctttcagtgtcaaaccttgtgagcaaagccagggcaacaggctctaagctgacaaaaaagtttaccagtatcttccatagagatggccttttcattcatatagattccatcggcaagtcaggccagacctttcagactctgacttgtaaaaaagtcttgtgtaaggaaaacttaccagtttgcaactagtgtttggtcactgctgagagaaacaaatattaaaaaataaataaatatgtctcagagagttaaataggcatacttggaaacacgaaagcttggaaaatgaatttaatatggcagattttattgagaatgcatcatgagtcataggagttcagaaatcaggaagttcaggaagaagaaaaagatcacaaaggcaagtttatgattacacctactaatcgaggaactgcttgctctgcaaccagtagatgatcacgagatggtcagatcttggtaggcccacaagagatgtcaaaataaaattctcaaaaataaacatcctagagacctccagttctggccaagctggagtttgccctttcctcccagatggtccctctacatcagaacaccctgaatataacagcaaaccagcaaagaaagctctgaaacgtggaaaggggaaagcagaccgactcatgctctcaggactcgagcaagaacacaggcagcgcattcccttggtttttctatttccacccaatatcccagacagggcaccgcagaagcccccagtccagaaccaccaacaatggcagacacaaagctccaagaaaagcctatttcctctgccaaaagaccataaaaaacgtgatctaaaaactgaaaaacctttgtgacaaattcccctcccctacactagacaaacaacaatggaaaaaccttatctcccccaccccccaaggtttcagggaacaagaaggaaacttgtcttctatcctgcctctctgaggcagatggtgatgatccaattcacctgtcagggtagtgtcagtggtgtccagcagcaagatgagccttcaccttcacctgacatcaataacactgaacaaggcagtccaagttgggactagtaagcattccatttatccccatctctggtgtcagtgatgcccagtggaaagttgaacctttacactcatccaaactcaatgaagtggtgtgaggcggggctaatcgacactctgctttcccgctcaggcattctgtgcaagctaggccctatggagagctgtgcctcctcatccacccatcatcaagatggaatcaggtggtgggaggcagggtttgttggcagtctcctttccccctccttcccctgatgttctcagagaccagtggggacctaggcttctgccccaccacactgcagcaacaaaactttgagtcagccatccagttcccctttccctaaagcctagcaaagaactgtgcctatactccccgaccccacctctgaggtaacaaagtgtggtgaattggtgcccccttttttattggaaatgttctcaggggggctagggtagaagttcagctcccacccccagccatctgtgaagaggcaaggtgaaccagcaatctagtttgctaggatggtatcagaacaggaatctgcacttatcaccttatgatatgatgggaccaccatcatatatgtggtctatcattgaacaaaaagtcattatgtggtgcatgactgaatatggactatcttaatgaaatgtcatcacagccttatgaggttaaattttttactattcccagtttaaagatggataataaaagcttggaagagtttacctggccaaggttatttagctacaaagtggtaatgccacggattcaatcctaagatacctgatgcccattaccccatctactgaaagatgacactgtactgcaaaaattaaaacagacatagctgatctgcttctttacctgtaattagagtaaaagaaaacaacaaaagaaaacaaaaacaacacagtgacatgctaactgtcatgaagaaaagtaccacatgtctgataaggtgatcagagatgtacactaagtaaggaaggtagctatagggatatctaaagccaggctgttacagaaaaacactcaacggtatgggagtatgcttgctgagctagtgttagagcaacaaaaaggaggctagtgtggctggagaaaaatccatttattcattcaaagtatccactgaagcaggcattgttataggcacttagggtacattaatgagcaatagacaaagatatttgcccttctggaatttttatttttccaccatgggagacagacaataaaaaacaaaaacagcatatgattaaaatatattgcattccagaagatgactgcgggggggaaaaatcaaatagggaagaagtggaatcaggagtgtgggctgagggttggacattcaaacaaatattggctgctttgcaattgatagtattattagatgggtggaagtcttctcctttgtgccgcctttgccaggcatcagtgtaaatgctctgttggcttcactgcagaggacaacacatttttcctatctttggtcaggactcagttccttctttaatatatcagagaaccagagacactaatatctgacagccttttgccatcaagtggccatgcgttttttaagtaagcatcccctgctacacgtccactaaatttgagcttttaactgtctgtgttgagacgtggcctggtagaaaccctcgctggggccaggcgcggtggctcacgcctgtaatcccagcactttgtgaggccgagtcgggcggattacgaggtcaagagagggacaccatcctggctaacatggtaaaaccccgtctccactgaaaatagaaaaaccagccgggcgtggtggcaggtgcctgtaatgccagctactcgggaggctgaggtaggagaattgcttgaacccgggaggcagaggttgcatgagatgggatcccgccagtgcactccagcctgggcaacagagcgagacgccgtctcaaaaaaaaaaaaaaaaaaaaaaaaaaaaagaaaagaaaagaaaagaaaaaaaaagaaagaaagaaagcaaagaaaccctggctggccagtgcccaggccatacacaatggcattgtgcctcacttttcacctaagacgaaatcagcgggtggggcaggcttataatcagaacacccctccctttccacctcacacactcccacccgcctgtcccacaatccttcctgcccctcccgctctcccacccttggtttctcgaaaccccttctccttccctgccccccgtcccccgagccccaggagggggaggggcaggaatctggctccgcctcccagtatggagatgattggtcaaaggaggtcacctgaccaagctgagccaattgaagtcctctccccactgctttgagaaggaaccgttaagacgctgggccccacccacaagattgcgtcttgtttgtggcaagattctgaggggaagtgtagctcccaggttggttccaagtcttcttccaattaggtaaattacaacaatatcttttccataaatttcctttcttttcttttttgcctttttttttttttttttttttttttgagacggagtttggctcttgttgcccaggctggggcgtaatgtcgcgatctcggctcaccacaacccccacctcccgggttcaagcgattctcctgcctcactcccaagtacctgggattacaggcatgcgccatcatgccaggctaatttttgtatttttagtagagagggggtttctccatattggttaggctggtctccaactcccgacctcaggggatccaccgcctcggccttccaaagtgctgggattacaggcgtgagcgtccgtgcccggcccttctataaattttatataaactaggccttttttggcctacattacctagggtcaaggtttagggattcataggaaaggcaaatccggctggattgctcagtggtccactctccagtccactctctatgtatcccttatcttcacgtgtgattaggttcaattgtatggctaatcacttcatgttctctctttgcaatttctcaggcaggttttctcttcttcttcagaaagttatatttctcttttgcatcttagttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagccactgattttgtcttttaaaattctttactctgaaataattttagacttacagaaaagttacaaaaatgattatacagagagccctcgcctggatttccttaatgttaacatcttatataaccatagaaaaattaccaaaactaactactacattacattgatgcactaattgacattactacatcgatgttaattaccaacagttagcattgatgtagtactattaactaatctacagattttatgtgaatttcaccagatatctcactgatgtcctttttctattctaggatcttatccaggacgcttcattgcatttggtcttcatttctccttagtctcctccaggctgacatttcctcaatctttattggtcttccacagccctgacacttttggagataccagtcaggtattttgtggaatgtctctcaatttgtgtttgtctcatgttttcttatgattagattgaagttgtgcatttgtagcaagcacacctgttttattctcctccctttcccagtggcgagggagggattcccaccctagtgttatgggggcggctgaacacatggtaccctatactggacagacggaatccacagcaatttatcagtaacatttactcacaactggagagaggagggcacctcacgccaggtagagccacacagtgtcacactctggaagagagtgaacaagcaggggctttcagggggaagtctttgtagtaaccagaggatgaagtgaccgttggttcagggtaggacgattggcttgtttgaataattctgcaggctggtggggacctgaaacatgctacccagagataagcaggcactgtgtctgttcaacatgataataaggagggtactttggccagggggcctttctccctgggaacccaatagggaagataacttgtggtgaggccattcagggtcctcctgttctaccccagatgtcaaggcatccatataattggacctctaattttaggtcttatgcgacattaccgcaaacgtgatttcgttcccttctatgtggatcatgtcaggggtacatgacatccataagttgtattactggtggtgctcaccttgatcacttggttaaagtggtgggagttatgctgccccagtgtaatgctactattttcctctttgttagtaataaatatagtgtgaaaagttctttaagaagaaacacaatagatcctcttatattcctgtttcttcgcagactttgacccactactgttaaaatctgtctagggatcttgcctacagcaaatattacctaatggtgattttctgttttcctaatttctgctacatttattaattggaattcctctgtaaggaagagctatctttactccctcattcatttatttcttcaatttatttatctcagtatgggctcttgaataattatgttatacatgccaggcttaatacctaggtgatgggttgatgggtgcagcaaaccaccagggcgcaggtttacctatgtaatgaacctgcacatcctgcgcatgtatcctggaacttgcaataaaataaaataaaaatttaatctaattatatcattattttgttctttgaactgttctagccttggccattgggaagtcattttggttggttctgtggtcttttgatatgaccctatccttttttggtacctttttctggcacaataagatgttcagattcagcatgtgtgtgcccccctcccctcacacacacacaccccttatagccctggattaaaacaacttctacgaggagccccggttccctttcttggggaatgatatttaccaaccagtatctcggtgtgtgttcattattaatggcgtttcattgctgctaaggctctctctatggagagggttaggaaataatgtatgtatacacccatgcctatagacacatccacatttattttggtatctatctgtatgcatagctattaaaagccaggagcttgtattgatactttcaattccaatcattctagacttatttgtagattcgttctccgacctggctttcattatcaaatagtttacatacctgtttatttctggtcagtagatacataaagtagcgcctgaattgctaacaaatgcccctgttgcaaacatattaataacttatatttttgtacagttgtttttgtctttggccttagaggatatagtcaaaatactgctctccaaagttatgtatcttagatcttttcttcctctctccttcagcgtggttaagacactcatttgtaatattgttagttgaacctgtttctgtttgatttggggtaccctcaccccaatatcccggttgattttaattttttatttatattttgggtatgtgcatcattactatgatccaaagagtcagggttatacaaaaacctatactcggagaaatgtcactccttcgtcatcccttctaccctgttcccattccccatttctttccacttctttccctggccctccctgtagggtaatcagcccctttggtttctggtttaacctttcctgtatttattttgcccaaatgagcagatacatacatgttttctcatattcctttcttacacgaaggatagcatactatacatgttcctttgcactttgcctttcctacttaacagcattcttggaaatcactccatattgtttcacagagatcttcatcgttcgtttttacagctgcattgtactccattgtgtggctgcgccacacatagtttattcaaccactcgcctatgtttgggcattttgtttttaatacagaaaccaggtctcgctctataacccaggctgactgaagtgcagtggcacaatcatagctcatggtaacctcaaactcctgggctcaagcaattcacaactgcctcagcctcccaagtggctaggactacaggtgtgtgccaccatgcctggctaattaaagactttttattttttattttattttttgtcgatatggggcctcgctatgttgcccagactggtctggatctcctggcctccagtgatcctcccgccttggtctccaaagtgctgagattacaggcatgagccatggtgcctggcctgtatgggcttttaaattccttccaagattttgcagttacagacattactcccgcgaataaccctggacatgattttttttttttttttgtattggtagaaatgtaccttcaaggtatattcccactggtaggattattgggccaaaagttaagtgcacatgtagttttcttaggtgtttccaagtttctctccagaaggattgtactggttttcatttccattagcaatatatgagaatgacaatttccccacagcctcactaacagaacatgttgccttacttttgaaacttttttctacgggttaggcgagaaatggtgtctcgctgtttctgtaatatacctttgtctaactatgagcaagttttgacacttaaccatatatttgaggactgtttttatactttttgttggaattatctgttcatatctttcccccatatttctattgctgttgtggtccttcatccctcaatatttaagagctctctatatatttggaatattatccagttgtctgcgatatgtgctgcaagtactttacatcaatttgtcagttgccttttgatttatttatgatgcatttgcatcactttcgtttatccttatgtggtcaaatggattgattatttttttctttcattgcctccggaatttgaatcctagttagaaagcttttccctacagtggggttctgccatgttttgttttgttttgttttgttttttctttcttttctttggttgacatggagtctcgctttgtcgtccaggctggagtgcagtggcgcgatctcggctcactgcaacctctgcctcccaggttcaagcaattctcctgtctcagcctctcgagtagctgggattacagccgcccgccacctcgcctggctcattttcgtatttttagtagagacggggtttcaccattttggccaggctggtctcaaactccggacctcaggcgatccacccgcttcagcctcccaaagtgctgggattataggcgtgagccacccccctcccccggccactgccatgttttcttcaagaacttacatggtttcatttgttatgtttagatccctaacccatttgcagtttattcttgtgcatgctgtgttatatggatctacctttatttttccagacgtctcagttgttccaggaccatttattaaatgtccatctttgccctaaagagtttatgtgccatctttatcatgtactaactgtcatatgatttggttgtatttctgagttttctattctagtccactgggctattagtctattcttgcaccagtgccacaatgtcgtaattacagaggctttatagtgtgcttttctggctgatatcataagtcccctctcatagattttctttttcacgtgtttcctggctatgcttgcatgttttcacaaatatattaactttattatcaatttgcctaaatgcataaaaatgtgtgctggcgtttttgcgactgaattaaatttatacaccaatttaggaagaaccgacatctttttaatgctggattattccatctaggacagtgacgtagtctgtttgggctgctattacaaaataccatagactaggtagtttataaacaacagaaatttatttctcgcagctctggagactgacaagtccaagataaagattctggctgatttggtgtctggtgaggaccctcttcctcatcgatggtactttctaattgtatcctcaacatggtggaagggacaaggcagctctctgaagcctcttttatgagagaactaatcccattcataagggctccacccttatgacctagtcgcctctcaaaaggccccacctcctaatggcatcaccttgcgggtaaaatttcctaacctgcacattgtgcacatgtaccctaaaacttgaagtgtaataataataaaataaaataaaataaaaataaaaataaaaaatttcaagatagtaattttgggggtacacaaacattcagaccatctcagatagcgtatgtgtttccatttgttcaagtcttctgtggtgtcattcaggcatatttaaaaatttttcttgtataaatgttgttatcaagtttattcctaaactttaatccttgttgctagtgtatatggggctttgtctgtgaatgtatcctccagctgcttattttttgtgtgtgtattaaaagactgctgattttttgtatgttaattttatattttgctaccttaatgacttcttttactggttcagttgatttatcatcgtttctatagggtttttcaggtatactataatatcatctgcatgtagagatggctttacttctctttgtaaaaagtaagttttattgtgtatatctaaggtatacaacacggtgttatgggacacgtatggatagtaaaatagttactatagtggaacaaattaacataacccattatgtcacatagtgacccatttttggttttggtagcagtaggcgctaaaatctattcatttagcagaaatcccgcatcatacttaatagtacaattgtacaaactgtattccagcatgttgtgcactagatctctagtctctttcatcctacatatctgctactttgcatcctctgacctacatctcccgctttcctcctcccatcccctcctccccaccccgaccctgataaccactgctttattctgtatctctgtatatttgagttttgttttacttttatttttttaagattccacatataagtgagatcatgcaatatttctctttctgtatctggattatttcactattatttcattgttatagcataatgtcctccagattcatccatgttttggcaaatggcaagatctcctttttaaagtgtatacatacaacacattttctgtatccatctgtcccttgatggacacctaggttgtttccatatcttggctattgtgattaatgctgcagtgaacatgggagttcagatacttttcaaagatcagctactttcaaaaggtggttattttatttcctttaagtagatacccagaaaagcagttgctgggtcatatgatagttctctttttcactaccatatttttttctaaaatagaaaaatgtagaactaccattttatttactaaaacagaaaaaaaaaatctatttctttaggtacctccatactgttttccataatgattgtccctatctacattcccatcaacagtgtacaagggttcccttttctccacacactcggcaatgtttgccatctcttggctttttgataatagctatcctaatggttgtatggtgttgcctcatagtagcttttatctgcattttcctgatgattaatgatgttgagcactttttcatacacctgttagtcagtgtgtatgtcttctttggagaaatgtctattcaggtcctttgcccgttgtttaaatttgattgtttttctgctatggagttgtatgatttccttacaaaatttggatgctaaccccttattcatatatatgttttgcaagtatttgctctcaatgtgtaagttgccatttcattttgttgattgttccctttgctgtgctttttagttcttcttattcattcctaggaaaatgatctatttctctgctcagttgactaatacttgtaatgcaagattgaataggtgtgaggtagtaggcatgctttccttgttcctgatcccaagggaaagcttcgagtgcccccccaccccattaaataagttactagcattaggacttaggtatatatgttttatcatgttaagaaagcatcctgtggtgcctattttcttaaggcttttctattttttaacataaagaggtgttgaatttttccaaaggctttttcaacatctgtggtgataaccatatgatatttgtctttaagtatattaatatggtggatgatatcaaggtactttctaatattgagccaatctgtattgatgggataaatcccactttgccaaagtatattatgattttttaaatatgttgtttgctaatattttatctagcatttttgcatctacacttatctatccatgtcacacttgcttcataaaggaagttatgaaaatttcctttataatgctgttgaataatttatagagcattggcactctggtactatctgatctttgaaggtttagtagaattgacctgtaatagcatctgagccaggtgcttcttgggagttattccttaataactttttccatttttttctgtaaaaattggccaagttaagccttccagcattagagtaaaaatcttgataatctgtattttcctaggaaattatttatttcatgtgtatttttaatttctttatacacaggtttgaaaagcaacctaattttttctgtttaaatgattatcatttgtcgtttattattttgtatatttgtgctctctccctttcttccttcattaatctgcctagtgagtttgtccattaaaaaaaaaaccaggattttgatttaataaatatacacacattgtttttctactatgtatcttattaacatctgcttatgtattcattcattcattcattcattcattcattttaatgaccgaatctccctggatcactcagtctggagtgcagcgttgtgatcacagctcactgcagccttgagctcctgggctcaagcaatcttcccacctccgcctcctcagtaagtaggactacaggcatgttccatcacgccctgctaaagaatcattattattattattattactgtagaggcagggtctccttatgttgcccaggctggtctcaaacgcctggcctcaagtgatcctcccgcctcagcctctcaaagtggttggattacaggtgtgagccaccaagcccggcaatttctgcttttatgttatttctttatttgtgtttcttttggtttcccgggttgttcttttattagatttttgaggcagtgctttaatttgtctaattttattcgttcattttcattgatgagagtatttagcgctctgaatctgcttccaatcactgctttaactatcttctacagagtctcatatgtaagctcttataatcactcttcttaaatatttctgtaacttcagttggtatctcgtctttatctcgacatttgcttaatagaagactgaacattttttccaggtagaagagcctttgtgctttcagtttgtgttagtaagttctacttttgttgcatcgtgattgcagagggttggttgtaatatttctactttatggaaattagcgaggccttcactgtgaggtaattatgatcacgttttgttaacgtgccatcagcttttgacaaggtggtatattctttatctccaaggtgtagatttatgtgtgtgtatgtatgcctatgtgtgtatacacacacacaatgtatcttattgtgttgtttacattttcggtataggtctctttattgtaccactggatttgccttgtactgagacttgccatgtattaaatctcctattattactgtgcttcaatgtctccataccttttggcattacaaaggtggttcctatgttatttggtgcataagtattcctaagtattatatattcactgtgaattttcaattttaatgttagcatgtaaactttgtcattaaaaaaattacttttagcacctgctttcttattgaacattttactatctggtccactagtttgtttttaacccccagtctccttttaacactcatctactgccttatgaaaaaaaaaaagtttattctctttttctttctatctctctcacttctcttattttacttgcactatttctttttttccacaatataaaataaatgcacgttagtcattttccttgcttcaccttcattttagtattagataccaaatgcttgccatcagatgttgtagggaagattttcctgtcgttacctgtggaatcacaatcccagtttaccctttagaatataagttagcaaacgttttctgtaaagagccatatggtaaatattccaaccagtgggccatagtttgcagacccttgctctagtggagtcctcaggaagggctgatgggtacataatttcctaagttcctgtctgtttttctataagctgtgatattagtgaaggatcggctgagctggatatcaaatcagtacttcagacgtttttctcagcccatttctgagtttagagttttaagtaatattctaattcaaggcaggttttatatcctcaaatgcttgtttgaatggaattaattctgtttgcagggttgacgtacagttccttctgtttcatggttgtttaatatgtgtgaaatttgtcttctgctctttttctctttctggaatgtttttgtaaggaattatccttccttttgttcatttttatgatattggattgttttaccagattcctattttacaggtgctattttctgtcagtgtagaaaaattcaggcctgaaatttactgatttcgtttgcttgttttggtagcggacaaagaagttatgagtgctctgattctgtggttctcttatgtcttgcaagattcttcattttccccttttgtttcttttccccatcattaccaaagtggcaaagcatgcttctccctttctgtttgcccttactcttacccagaagctgtggatttcaaaggctacttttattttattttattttaatttgagatagagtctcgctctgtctcccaggctggagtgcaggggtgtgatctcggctcactgcaacttctgcctcctgggctccagcgatcctcccacctcagcctcccgagtagctgggaccacaggcgcacaccaccacacttggccactgttttaagttttcgtagagacgaggtctcactatattgcctaggctggtctgaaactcctgggctcagtggtcctcctgcctcgggcctcccaaagtgatgggattacaggcatgagccactgcacccaacccaaagactacattctaagatcatctctacccctttaaattacacgtattttagaggtccttccctgtagtccctgctcttattatctgggacacctttttggtatttttttagacttagtctgggctcagtcattttaactgtagtttcggaccaactttaagtcccttgcctcttcctttctctgtgtctcttgcagcttttcttggtctgtctttgcttgccacaaagactagtgatgagagcatgacagatcttgtgctgggatttcatgccttttctccttttactcactactaaagatttggcattatctgtttctaagtaacgatgaggatgtggcttctgtatagatttacatcttcctttctgattggtttatatccttttgacatgaaacattgggaggcaggtgcctgggtggtcgacattgccttatgctgacttacagctgatttcaaatggcattttatcttatctaaatacatatgtgtgtgtatacacacacagacagacagacaccacacacacacacacacacacacacacacacacacacaccaacacagacatttatacacacatacaagtctatttgtattccatgtctatagtagaggtctcttgaagtggtcgtttgatttaccatatatttgttcaatacatatttcatttattgctatctttggtggcaggcaagagactgtgaaaatcttctcaggatttgttaatgttcctcaccctaaagcaggttcatgtcaatggaccaaaaggtgccagccacactgctagagctcgctgcatggagtctgctgagtgatgagcctgcagctatccatgctcttgaggagctcccatgagacctctttgttccattgttcatcactgccttcttgggtgggcagaagatgaaactaaaggccatggtgaggatttggccctcccgttgtctccatgttggaccgttgagtgtaagggagtcacactatgaaatcttgggagccacgattgatggtcctgcagatcctccctgcccagagctcttcccctcggtaaccctatgtacactagagacatagtgagtcatcaggagggtatgctgcagcctgaggcagggggtggcctaacagtctcccaaaggtggttgacggtgaatgctgaggatctctgtgaggttgttggtccaacacttggggtcaccttaaggactctaatgtcttacagaggtgattatggaatagaggtgattgagagtactattgatggattcacctactgggtatgattacatagaagaacaacatggacaccagactggggaggatcggaggagaaggaaggatgggaaaaacaataaaagatgttgagtttgtacaaaaaaatatttgttggtagattgtttacagagtgaagagcaaagataaagggtttgcccctccttcccctcattgatgttgctgggttatattaaaatcagccacctttcatattctgtctcttcctcttcctgcagacggccaaaacggagggtcctggatttaaagcaggacccagacagcagaaccacatgctctgagatcaggagcacattcccattttgttttcagtcttgcgtttactctcagcactctatcctgaaaatagaagaagccaagcgaagtgttaggtgcctggaaattgtacatttagagtctgagtctcggcccatccagggaacgcatgggattgttagtggacatttcccttgatggtaccttgagaacaaggcaactcttttctttcctttcgagtaaagttgagcagagccttgggtccttgcatctctgctgcagagatttgcaaattcatcaagtgtctgcccacaaaagcgtcctgtagtttctggatctgggatgcactgatcacctggaagtaggtcaggcttgtttgagtgaagtcagcacccttttggcacagaagatccaccaggacagacttagtctatctaaaatccttttaaaatcctgtaaggggagaaacttctcaacttttttcactcatcatgagcagatgaacaacctccaggaactcagcttgtcttgcttctgcctcacagatcagctggacaaaatttccgggtgagaggttggggagggacctgggttccctgaatgccccattacgaacaaaagagtgcgactattcttagatattcttaaacactttgtaacctatttctccttccacatcagcacgggcactgctgggtgttttaaactggccaagctagagagtgtggtccctcatgctgaggagaaagacaggattagaaaagtcagctgtgcccagtcagtcagtcagtcagtcagtcaatcaaccatgtgcagacgtgcagacactaagataagtctgtcgacatattggcgaaaaagacaacagtcctgcttttattggagtgtgtagccttctagagaggaaggggaggcattcagtcggagaaataactgacgctgtagcactgatgcacatccccatgggctggtcacaataggtaataccgccagatcgttttgttcctgtagttttcccgaggcttaggacctgaatggagaacctgtcatttggaaattcgtcaaagggaattctcagtcggctgctttcccagacccatccccatcaaataactgaactagatacactgctaattatactgtaggcactaagttaaattctttttcccttaatctgtcccacaaccctctataataattgctattgtgcacatttgaaagattaaaaaactgtatctcagcgtggaaaagtaactttcttagggtcacaaatctattaagtctgactgtaaagtccacagtgttaactgctgttgcaatggatatacagattactttattctagagtcataagtatctataattcagggctgcttgctctaatccaaccctcattcttcagaaatgccttccttttttctctctacagagccctgccatctcatttgtacacactgtatgtgtctttctgtggactttctaccagagagacatcactgtcctatcccagagctctgaggttacccacctaagactgttgagtctgagtaacaatcagatatcctgggaagtttctgagccattccaggctctgctggagacggtctcagggaccctgcagcatctggagatagacaactgcctgataactgattctactttctctgttgtcatcccagccctgagccactgttcccacctctgtgtccctagctttgtcttcaaccccattacaatgcctgtgctcacgagtcttctgcagcacttaacagcgttgatggagctgaagcatgtgatttatcctgtccctgtccattgctatgaacaatggcaatcacatggcagtttggacatacaagcttgctaaagtgcaggcctcattgaaggtgatgctgcaggcagtaccacagaacgacatgaactagaccacccattctcagtgatcttcacaggacaaggagttgtttcatcactgatgtgtggccactaaaatactgagtgttcttgcctgaagcccaatttgtaaagacacataatgtgccattctgctattccaggaaactggtgttaggaagattggatatgtaactgacctccataaaagaaaaactctaagaaggaaacagcagactttacgaagtcttgtgggtctcttgcccattgtcctctacgtcctccttcttgttactgaccacagtgttgggtacgtgacatgggctgacccagtcgtggcacaccatttccctgtccacactgatcggttcacttatgggtacttgacgcaagtcaggacagttgaaacctttcctggatgtttttctggagtaggtgctggttactgaagccaataatattactcactgaggtcctttaatcttcctgtattcatgattgccttaggttgcttatgacaaaccattggcaattaaaatgaaaaacaagaacaacaagaaacaaactatccccactacctactggtgtctttatcagtatattgctatctcctttcctaggtctcagaagcctggggttcagtttgcccttatttcacacagattcaccaaagatctgttattagctaggtactgttcctggtgctaagaatgaataggcaaacaagaccctacaccaagtcactcacagtacagatcttcctatgttttgtctgtttccccgctcttttcttaggggatttgggaaagttattttgcccatctatggcccagaatttttttttttttttttttttttttttttttttttttttttgctttgccccttgcatactctgctcaatccacattggcctctttatgctgttggatagctcatcaagactcaggccgtagcttagatgttacgtcctccgagaggtttttctcttacttccctctccttacttaccccacttctctcccattacttcccttacttcaccatgctgtttttaaatgtaccatgtacatttccttcatggtacacatcattccatatgtatttgctccctctgctcctcccctagagttgcactattcagtatagtaaacactagccacatgtggctactgagcactagaaatttggctactccaaaatgtgatgtacgataactgtaaaacgcacacggtatattcaagacttagtgagaaacaaaaaatgtagaataactaactaataacttatttgtattgtttacgtgttgaaatgataagttactgcaggtcaaagacagtaaaaaaagaagacagagtactaatgtgtttatattgttcaacatgttgaaatgatagcactgcggcaaagacaatcactctcagcattcctattgaatacctccttggaagacccaaccggtacaataaagcaaaggaaagcactaaaaggcacacagattggaaatgaagtcatgaaaaagtgtccctatttactgacatggtggctatgtataaaatttctgggaatttatgaaaaacctcctagaactaatgagtgagtgtgcctaggttgccgtataccaggtcaatattaaaagtaggtcaactctatttttatatacagtcctccctttgcacagttctgatatgcactaaggtcattcaccgtgatttagttaaataacactagtcccttcacagtatgggtcaaatttcagttaccatggtaaactaactgtcagtaactacataaagaccaaacattgctgctggttcttcagtccacaaatcgctactgaaataacagatgagaatcatgatcagtggccagtcatgtcacttctttcaaattctgtttgtgtcgctccacaaatcactatttaaataatagatgagcatcaggatcagtgaccagtcatgtcacttttcttttaaaatctaatcatgtttggtcactgagtatctattatttatttcatgcatcaacagcaaagaatgaagctgagtttcctccttgtctcccagtgaactactcatatgacattttaccaaagaactggatagtttaaaaaggtaattggccaacaaagacagaaacatgcaaacaaatgacaagaaataatgctggaagtggaaattgcaaaacggttttgatggaaaggattaagatatcccagtgaaagtgacacttgcaaaaaactttacactacaggattccttggagatattcatgacacagaaagaacaaagaataaagttgtggaagctgatcaacactcaaaactgagaaacaaaatttgccaagtcacgggaaaaaatgtctactccatatcacaattaataagatgagaagaaggcaagaactgttcatactactctttttttttccatgagaaattctggatttaattttatttggaatgtcaccaacttctctggcataacatatggtataattatttttagaatgtgattactttatgaatatttgaagacatttttatgttttgagcacttttctgaaacaatagcttctgttttagtgcatagtagtggacaaggccagaattgatgtttttctgtaacattaagctagtaatggtagaagcagttagataaattcaagtcccttgactccagtcacaagacttcctctaaattattgtgactttgtaaaatattcttaatttgaattttttttttattaatccaatagttatttacattgatcttaagtaaaatttgtatgtggcggccaggcacggtggctcacgcctgtaatcccagcactttggaaagctgaggcaggcggatcacttgagatcaggagttcgagaccagcctggctaacatggtgaaaccctgtctctactaaaaaaaaaaaaaaacaaaaaacaaattagtcagttgtggtggcgggcgcctatagtcccagctactcaggaggctgcggcaggacaattgcttgaaacccggtaggcggaggttgcagtgagccgagatcatgccattgcaccccagcctgggcaacagagtgagactctttgtctcaaaaaaaaaaattgtatgtggctacttattgttaatttcactttcattgacatttctactttcacttcacagtgctttaaaaataggcaggccaacattcagattcaggaaatacagagaacaccacaaagatactcctcgagaagagcaactccaggacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgggggccaatattcaacattcttaaggaaaagaattttcaacccagaatgtcatatccagccaaactaagcttcataagtgaaggagaaataaaatactttacagacaagcaaatgctgagggattttgtcaccaccaggcctgccctaacagagcttctgaaggaagcactaaacatggaaaggaacaaccggtaccagccactgcaaaaacatgccaaagtgtaaagaccatcgaggctaggaagaaactgcatcaactaacgagcaaaataaccagctaacatcataatgacaggatcggattcacacattacaatattaaccttaaatgtaaatgggctaaaggctccaattaaaaggcacagactggcaaattgggtaaagagtcaagacccatcagtgtgctgtattcaggaaacccgtctcacgtgcagagacacacataggctcaaaataaagggatggaggaagatctaccaagcaaacggaaaacaaaaaaaggcaggggttgcaatcctagtctctgataaaacagactttaaaccaacaaagatcaaaagagacaaagaaggcccttacataatggtaaagggatcaattcaacaagaagagctaactatcctaaatatatatgcacccaatgcaggagcacccagattcataaagcaagtccttagagacctacaaagagacttagactcccacagaataataatgggagactttaacaccccactgtcaacattggacagatcaatgagacagaaagttcacaaggatatccaggaattgaactcagctctgcaccaagtggacctaatagacatgtatagaactctccacccgaaatcaacagaatatacattcttttcagcaccacaccacacctattccaaaattgaccacatagttggaagtaaagcactcctcagcaaatgtaaaagaacagaaattctaacaaactgtctctcagaccacagtgcaatcaaactagaactcaggattaagaaactcactcaaaaccgctcaactacatggaaactgaacaacctgctcctgaatgactactgggtacataaggaaatgaaggcagaaataaagatgttctttgaaaccaacgagaacaaagacacaacataccagaatctctgggacacattcaaagcagtgcgtagagggaaatttatagcactaaatgcccacaagagaaagcaggaaagatctaaaattgacaccctaacatcacaattaagagaactagagaagcaagagcaatcacattcaaaagctagcagaaggcaagaaataactaagatcagagcagaactgaaggggatagagacacaaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatatcactactgatcccacagaaatacaaactaccatcagagaatactataaacacctctatgcaaataaacttgtaaatctagaagaaatggataaattcctcgacacatacactcgcccaagactaaacctgggaagaagttgaatatctgaatagaccaataacaggctctgaaagtgaggcaataattaatagcttaccaaacaaaaaaagtccaggaccagatggattcacgcccccgaattctaccagaggtagaaggaggagctggtaccattccttctgaaactattccaagcaatagaaaaagagggaatcctccctaactcattttatgaggacagcatcatcctgataccaaagcctggcagagacacagcaaaaaaagagaattctagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatacacaaatcaataaacgtaatccagcatataaacagaaccaaagacaaaaaccatatgatcatctcaatagatgcagaaaaggcctttgacaaaattcagcaacccttcaagctaaaaactctccataaattaggtattgatgggacgtatttcaaaataataagagctatctatgacaaacccacagccaatatcatactgaatgggcaaaaactagaagcattccctttgaaaactggcacaagacagggatgccctctctcaccactcctattcaacatagtgttggaagttctggccagggcaatcaggcaggagaaggaaataacgtgtattcagttaggaaaagaggaagtcaaattgtccctgtttgcagatgacatgattgtatatctagaaaaccccatcgtctcagccccagatctccttaagctgataagcaactgcagcaaagtgtcaggatacaaaatcaatgtgcaaaaatcacaagcattcctataccccaataacagacaaacggagagccaaatcatgagtgaactcccactcacagttgcttcaaagagaataaaatacctaggaatccaatttacaaggaacgtgaaggacctcttcaaggagaactacaaaccactgctcaatgaaataaaagaggatacaaacaaatggaagaacattccatgctcatgggtaggaagaatcaatatcgtgaaaatgaccatactgcccaaggtaatttatagattcaatgccatccccatcaagctaccaatgattttcttcacagaattggaaaaaactactgtaaagttcatatggaaccaaaaaagagcccgcattgccaagtcaatcctaagccaaaagaacaaagctggaggcatcactctacctgacttcaaactatactacaaggctacagtaaccaaaacagcatggtaccggtaccaaaacagagatatagaccaacggaacagaacagagccctcagatataatgccacatatctacaactatctgatctttgacaaacctgagaaaaacaagaaatggggaaaggattccctattttggaaatggtgctgggaaaactggctagccgtatgtagaaagctgaaactggatcccttccttacaccttatacaaaaattaattcaagatggattgaagacttaaatgttagacctaaaaccatagaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccgtcagagtgaacaggcaacctacagaatgggaggaaaattttgcaatctactcatctgacaaagggctaatatccagaatctacaacgaactccaacaaatttacaagaaaaaaacaaaccaccccctcaacaagtaggcgaaggatatgaacagacacttctcaaaagaagacatttatgcagccaaaagacacatgaaaaaatgctcatcatcactggccatcagagaaatgcaaatcaaaaccacagtgaggtaccatctcacaccagttagaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgatgtaaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtagggacatggatgaagctggaaaccatcattctcagcaaactagcgcaaggacaaaaaaccaaacaccgcatgttctcactcttaggtggggattgaacaatgagaacacatggacacaggaaggggaacatcacacaccggggcctgttgtgtggtggggggcacgggggagggatagcattaggagatatacctaatgttaaatgacgagttaatgggtgcaggacaccaacatggcacatgtatacatatgtaacacacctgcacgttgtgcacatgcaccctaaaacttaaagtataataaaaaaaaaaatgacctgttggatttctactttgatgaagttaatgtcatttttaggcctaaaactttttcttttttaaaaaaatcttcaggtgtttttaaattttatttcattttgttttaagttccaggatacatgtgcatgacgtgcaggtttgttatatagacaaacgtgtgtcgtggtttgctgcacctatcagcccatcacctaggaattaagccccgcatgcattagctatttattctgatgttctccctcccccggtgcccccgaccaggccccactgtgtgttgttcccctccctgtgtccatgtgttctcgatgttcagctaccccttttaagtgagaacatgtggtgtttggttttctgttcctgcattagtttgctgaggataatggtttccagctccatccatgtccctgcaaaggaaatgatcttgttcctttttgtggctacatagtattccgtggtgtatatgtaccgcattttctgtatccattctattattgaaggccatttgggttgattcattgcctttggtattgtgaatagggcagcaatgaacatatgcatgcatatatatttataatggtatgatttatattcctttgggtatatacccagtaatgggattgttggttcaaatgatatttctgtttctaggtctttgaggaatcaccacactgtcttccacaatggtggagctgacttacactcccaccaacagtttaaaagcaatcctatttctccacagcctcgccagcatcttttgtttcgtgactttataaaaaccgccattctgactggtgtgagatagtacctcacagtggttttgacttttatttgtctaatgatcagtgatgttgagcttttttttatatgtttgttggccgcataaatatcttcttttgaaaagtgtttgttcatgttctttgcccactttttaatggggttgtttgttttttcttgtaaatttgtttaagttccttgtagattctggatattagacctttgtcagatggatagactgcaaaaatttccacccactctgtaggttgtctgttcactctgatgatagtttcttttgctctgcagaagctctttagtttcattagatcccctttgtcaatttttgcttttgttgcaattgcttttgatgtttttgtcatgaagtctttgcccgtgcctgtgtcctgaatggtattgcctagattttcttctaggatttttatagttttgggttttacatttaagtgtttaatccgtcttgagttaattttggtataaagtgtaaggaaggggtctggtttcagtttactacaggggtctggtttcagtttactacatatggctagccagttctccaagcaccatttattaaatagggaatccttaccacattgcttctttctgttaggtttgtcaagggtcagatggctgtagatgtgcagtcttatttatgagatctctattctgttccattggtctatatgtctgtttttgtaccggtaccttgctgtttcactgtcaagtgctggaaaaagaacaaaaggaactgtctctcattgtcgatggaagtataaaatggccaagacactttgaaaaacaatttggcaggtttgcatgaagttaaaggtacacttatacagcaatcgcactccagggtatttacccaagagaagtgaaatccttcttcccaggaaaccttccagcaaaacgttcttaattgctaaaaactggaaacatctcaaatgcccatcaactggggaatggataaacaaattgtggtatgtacctacactggaagactactcgacaacaagacagttctaagtactgataacataatatgcgtgccacagaatggatgactctcaaaatacattatgctaagtgaaagaagacatactcaaaagactacatacaatgccatttctttggctttatagaaaagggaaaactagagagagaacaaatcaatcagtggttctcttgggctatagaagatcaactttaaaagggcatgagggcactttatggaggtttggacatgtcctagatcttcattcttgggttgatcacatggttgcatgcttttgtcaaaatgcacagaatggtggactgaaaaggggagaatgttatactatgtctcaaaactcggcaccttgattgttattttgtaacctgcctttctccccactgtgtcctgaatcagcaaaaactctatcggttctagggcgtgattcctgctgtaatccccaactctgacagactgtcatccctgtattcctgattctgacctggtttgcctctgatttggaagatatgctttctcagatcctctgccactcttactcattaaccttactcagagcctcctgaaactcactcagtgcaatacaaaggagggatccacagctgcacagaaggtggttgtcagtttctggcttttccatgattcttctgagatgtgttgactaggagtccctgggcttcatccatagattcattctttcaccaaatatgtgttgaacattttccatatgcggtggattctgtcatcatttcctgtttattctccactgcctaacccagaaccagatgttcacgatgtccagttaacaaacgcttctggagcacatatgatgctctaagccctgtgcctggcaccagaaagacagataaattggaaaagaccatctttgtcatctctagcgtcacatgccctccgtggtggacataaagatctattaagcatgtcttttattttctgtgtcgtgatgctttgacatcctgggccttgctgaccctggaaggcttgctcctcccaggcctggtaaggcaattcttagaaatagtaaacaccttgccctggagcgtgcttttcaaatgcaaacaaatcaacggggatacaatacctcccaaccatgtcctatatagggctctcacaccctgggtcactatccacctgccctaatcaccccaaggccaggtaccaggcaactagggacagcccctatgccccaaggctgcttaaattattcagactagccaatcctaaactggttactctcccttgcctgttccttcccacagaggcagagacaacaacaaatgctctggcttgcagttctcctgtctccctctggcccggaccaaccatggtgcttcgccatgagatttcccatgtctgggcatcctttcttctcttcggaactgtgactaacaatctgtctctccaaggcagtcatttcctgatctgtttcaaatgttctactaatccactctattttaaaacactctcagattcccctttaggatgttttcctcgctctgctgggagtgctgtccacagacagccttcagctaccagcttccttggagagcaccttggctccggagagcctccttgtttttccagtggcccacattcagtgactggtggaggcaggagtataaaatcagacatttttaatcaacgtaagaaaaccccaagggtcatttttagcttcagagtaccccatggagctggctgagggtaatgagacctcatagtagctcatttccttccttttccaaattctgtgttctgactgtgctctccacaggtactcatcccatatgtactctcacataaacatcctgcacaataaaatcagtcacacagactatctgttgcagtgcttcaagcatttgaaaaatatggtggagattgtaatggataaataagattctatggctactactaagctcaactgacactctagaagaagacaaagaaatcagagagaaattattatgcacttgaaagccgactgcgaaagccacagggcttccttgggattatacggagactttcaactcctggcacaggatggcagagaaagcttgtgatttaataatcatagaagtaaacctccaaagaaggttaaatttccacccaaagtaggaccgtttctccaggttcatggctcgcactgggcaaaattgagacccataatgtagtttggaatgagacctctagaaacctgaatttccacaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaagaaatcaagactgatgacaggtatactgaagagtttcgcagcccttccaacccctgccacaggaaactcgggatcctttgttcaattcctggacctgaatcaattttttacatctggaactttttgactgaaaaggaggttgggtacccaggcagagaaggtctgtgcagcaccacagcctgtggacacagtaatgattcacccagacctcccctcaagaggcatccatccgttgattcacgtcaccatgaactgtggaaaggaaaatgcccaggtatcttgagaaatgtcaagcatggagtaggagatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcttcctcttcctcttcctcttcttccttcttcttcttcttcttcttcttcttcttcttcttcttcttcttcttcttcttcttctttcttcttctatcccttcaagcatttattctttgagttgcaaacaatacaattgcattccttaagttattttaaaatatacggttaagttattattgactatagtcactgtgttgtgctatcaagtaataggtcttattcattgtttctggttaaccattaaccatctccaccacttccccaactccccactaccaatcccagcctctggaagccatccttctactttctgtgtccatgagttcaactgatttgatttttagatcccacaaataagtgagaacatcagatgtttgtctttctgtgcctggcttatttgccttgacatgacgatctccagttccctccatgctgttggaaatgacaggatctcattcttcttcatggctgaagagtactccattgggtatgtgcaccacattttctttatccattcatctgtcgatggacacttgggttgcttccagatcttagctgttgtaaacagttctgcagcaaacataggagtgtagatatatctttgacatactgatttcctttcctttgggtatatactcagcaatgggattgctggatcatatggtagctcaatttttagtttttggaggaacctccacacggttctccaaatggttgtactaatttacattcctaccaaaagtgtgggaactttcccttttctccacatccatgccagcatttgttactccctgtcttttggatataagccatcttaactggggtgagatgatatcgaatttttgacttgtgtttctcggatgatcaatgatgttgaacaccatttcatatgcctgtttgccatttgtgtgtcttcttttgagaaacgtccattcaaatcttttgcccatctttcgatcagattattagattttttcctatagagttgtttgaaatccttgtatatgctagttattaatctcttgtcagaggagtggtttgaaaatattttctcccattctgtgggttgtcacttcactttgttgattgtatcctttgctgtgaagaagctttttaacttgacgtgatcccgtttgtccatgtttgctttggtcgtctgtgcttgtggggtgttgctcaagaagtctttgcccagacctatgtcctggagatttttcccaatgttttcttgtagtagtttcagagtttgaggtcttacatttaagtctttaatctattttgatttgattttcgtatgtggggagagataggggtctagttgcatttttctgcatatgggtggtccaggttttccagcacgatttatcgaagagactgtcctttctccagtatatgttcttggcacctttgtcaaaaatgagatcactgtaggtgtatggatttctttctggactcccgattctgttccattgttccatgcatctgtttttatgccagtaccatgctgtcttggttactatggctctgtagtattatttgaagtcaggtaacgagattccttcaggtttgttcttgcttaggatagctttagctattctgggtcttttgtggttccatataaattttaggaatttttttttctatttctgtgaatagaaatagtatcaaaataggtattttgatagggattgcattgaacctgtagattgctttgggtattatggacattttaacaatattgattctttcaatccatgagcgtggaatatttttccattttttggtgtcctcttcaattttcttcatcagtgttttatagtcttcattatagagatccttcacttctttggcctagttaattcctaggtgcttaattttatgtgtggctattttaaatgggattactttttaaatttgtttttcaggtagttcactgttgccagatagaaatgctactgatttttgtatgttgattttgtaccatgcaactttactgaattagttgatcagttattagtagttttcttgtggagtcttttttttttttccaaatataagaccatatcatcagcaaacaaggataatttgacttcttcatttccaatttgaatgccctttatgtctttgtcttgtctgattgctctagctaggactcctagtactatgttgaacaacagtggtgacagtgggcatccttgtcgtattccagttcttcaaggaaaggctttcagtttttccacattcggtatgatactagctgtcagtctgttgcatatggcttttattatgttgaggtatgttccttctatacccaggttgttgagggtttttatcaggaagggatgttaaattttttatcaaatgctttttcagcatcaattgcaatgatcatatggcttttatccttcattctgttgatctgatgtaacaccttgattgatgtgtgtatgtagcaccatcctcgcaacccagggataaatcccacttggtcaagattaatgattgttctaatatattgttgaattgggcttgctagtatttggtggaggatttttgcatcaatatgcatcagagacaatggcctgaagttttctttttctttcattctttttgttttctgatgtttctttgtctggttttggtatcagggtaatactggcctggtaaaatgagtttggaagtactctgtcctcctctcctttttggaatagtttgagtaggattggtatcagttcttctttaagtgtttggtagcattcagcagtgaagccattgggtcccaggcttctctttactgggagagtttttcatatggctttgatctcgttacttgttattggtctgttcgggttttggattcaatcttggtaggatgtattgtatctaggaatttgtccatctcttctaggttttccaatttattgacatatagttgctcatagtagtagccactaatgatcctttgaatctctgcagtatcagttgtaatgtctcctttttcatttctgattttatttgcgtgtatcttctttcactttttcttagttagtctggctaaaggtttgtctcatttgtttaacttttcacaaaatcaactttctgtttcagtgattgttcagtgtattgttttcttcagttcaatttcatttatttctgctctcctctttattatttttcttctactaatattgggtttggtttgctctttcttttctagttctttaagaggcatcgttacattgtttatttgaaaattttcctcttttttgatgtaggcacttatagctatgaacttccctctgagtactgcttttgccatatcccagaggttttggtatgttgtgtttccattgccattcgtttcaatttccttcttaatttctgcattgacccactggtcattcaggagtatattgtttaatttccatgtatttgtacagtttccgaaattcctcttgctattgatttctagtcttattctattctatcgtggtcagagaagatgcgtgatattatttcagggttttggaatgttttacgacttgttttgtgacctaatgtatggtctgtccttgagaatgatccatgttctggggaaaagaatgtgttatctgcatctgctggatgaatcgttctgtacatatctgttagatccatttggtctacagtgaagattcagtctgaggtttctttgttgattttctgtctggaagatctgtccagtgctgaaagtggggtgttgaagtctccagctgttactgtgtcagggcccatctctctctttagctctagtaatatttccttcatgtatctgggtgctccagtgttgagtgcatatatatttaaaattgttacatcctcttggtgaatcgacccgtttatcattacatagtgacgttctttttcttttcttatagtttttgtcttgaaatctattttgtgtgatataagtatagcggctcctgctcttttttggtttccattggcatggggtatctttttccatccctttatttttagcctgtgtgtgctttataggtgaagtgtgtttcttctaggcaagagatcaatgagccttgtttcttcacccattcagccagtctgtgacttttgatgggagagtttttccaatttgcatccaatgttacggttgacatgtaaggacgtagtcctgccattttgttatttgttttctggttgttttgtgatcttctcttcattctttctttccttcttgtcttcctctagtgaaagtggttttctctggtgataagatttagtttcttgctttttattttttgtgtatccattgtatttttttttttttttttggtttgaggttaccatgaggctcaataatactatcttataacccattattttaacctgatagcaactgaacactatttgcacaaacaaacaaacataaagcaagcaagcaaaaagaaaactaatgaaaactctgtgccttaacttcatccccccacgttttaatattttgttgtttctatttctatatcattgcattgactatgtctcaaaaagttgttctagttattaatttttattggttcatcgtttagtctttctacttagggtaacacgagtttgtacaccacagttacagtgtcattgtattctgtgttcttctgtgtccttactattaccagtgacttttgtaccttcgggtgataatttattgctcattaacgtccttttctttctgattgaagtacacccctcagcatttcttgtaggataggtctggtattgatgaaatctctcagcttttatttgtctgggaaggtctttatttctccttcatgtttgaaggatatcttctagggtatatactattttagggtaaaagcgttttttgtttttttgtttgtttgttttccttcagcattttaaatatgtcataccaccctctcctggcctgtaaggtttccactgaaaagtctgctgccagacatttggagcgccattgtaaattacttgtttcttttctcttgctgctttcagcatcctttctttatccttgttctttgggagtttgaatattaaatgccttgaagtagtcttctttggattaaatctgcttggtgttctgtaaccttcttatacttggatattgatatctttctctaagtttgggaagttctctgtaattatctctttgaataaactttatactcctatctcttcatctccctcctctttaagcctaataactcttagatttcccccttcgaggctgttttctaggtcctgtaggcatgcttcatttttgtgtattttttcttttgtctcctctgactgtgtattttcaaatagcctgtctgcaggctcactaattctttctttctgcttgatcagttctgctatcgaaggactctgatacattcttcagtatgccagttgcatttttcagctccagaatttctgcttgattctttcagattatttcagtctctttgttaaatgcatctgatagaattctgaattcctactctgcattatcctgaatttctttgagtttcctcaacaaagttgttttgaattccctgtctgaaaggtcacatacctctctgtctccaagattggttcctggtaccttatttagcttatttggtgaggtcgtgttttcctggatggtgctgatgcgaatatttttttcttcagtttctgagtatgtgaactgttaggtattaattgtagtcttcactgtctgggcttatttgtagccgtccttcgtcagaaggcttttcaaatatttcagaggacctgggtgtttggatctaagctgtgtctgcttcagggggcaccccaagctcagtaacgctgtggttcttgtagactcatagagggcaccaccttgatggtcttggacgaggtccgggagaattctctggattaccaggcagagactcttgttccctttccttactttctcccaaacatacagagtctctctctctctctctgtctctgttctgagccacctaaagctgagggtggaatgacacaagcacccctgcagccaccactatgcggccaccactactatgactgcactgggtcagacctgaagccagcacagcactgggtctcccccaaggcctgctgtaattactccttggctactgcctttgtttgctcaaggccctggggctctacaataagcaagtggcaaagccagctaggactgtttttcccttcattggagagaggtcccccaagccccaggtgggtccagaagtgccatctgggaatcagggactagcatcaaaaaccttagaaggctacctgtggttctaagtattgtggctgagctgtcactcaaaccacaggacgcagtctttcccactcttccctccccttcccaaaggtacaagagcctcacactgtagccaccgccaccctaggccccgagcagtactggcagactactgccaatgttcccttaaggctcaaggtctcgtaagtcagctgtcgtgaatgctgcctggcctgggactcacccttcggggcagtgggctcccctgtggctcagggcaggtccagaaatgcagtccaagagtccagtcctggaactggggactccaagggtctgcttgatgctctaccccactatggccatactggtacctaagatgcaaaacgaagtcccctttacttttccctctgcttttctcaaactgaaggagttttgccccatagccaccacttgctggttatgtaccaagtctcacctgaagccaacaagtctcagaggttcacccaaggccctcgatgtagtgcctgggcatcactgctggttattcagggcccaggggctcttcagtttgcaggtggtgagtgctgccaggactaggtcctttccttcaaggcagtgggttcccttctggcccaggacgtgtctaggaatgtcctctagtagctaggtcctggaacaggggccacgtgactctgactggtgccctatcttgctatggctgggctggtatcccagatgcaagacacagtcttcaccactgttttctttctcccctcctcaagtggaaggaaggggtctccttcggagccacaaggtgtgcagcctggggttaggggacgggtgatgccagcactcccttggctgccccagctggtatctcagtatgtcgtgtgaccccccccctcccccgacccctggtccactgtctctgggcctaattcaacaccaggactcacctaagagttgcagttcttttttttgtttgtttttttgagatggagtctcgctctgttgcccaggctggagtgcagtggcacgatctcagctcactgtaagctccgcctcccgggttcacgccattctcctgcctcagcctcctgagtagctgggactacaggtgcccgccaccacgcccggctaatttttttttttttttgtatttttagtagagacggggttccaccgtgttagccaggatggtctcgatctcctgacctcgtgatcctcccgcctcagcctcccagagtgctgggattacagccgtgagccaccacgcccggccagagttgcagttcttatggcctagtctgcctttcaaatttacttggagacacagagtgctgtagcctgccatggtgaggtttgtgggaactcaagttctgatcactgggatcagtgattcccctctggctagggctgctttaaatgctccctctgttgggggggcatgagctgagtttggtccggttttcctttctgctctaacaggatagcactgaggtcattgcttcacaaatgctgtggtctccctccccctgcacccagagatgctctccacaccatgctgctgtggccaggggtgggggaggggtggcgtcggtaattcaggactatgttttggttctcagggagaatgcttccaggttttggcctttgagtaggatgttggctgtgggtttgtcctagatgactcttattattttgaggtatgcttctctgatgcccagtttgttgagggtttttgacatgaagggatgttgaatttcgttgaaaacctcttctgcatctattgagatgatatgtggttttcgtttttagttgcgtttatgtgatgaatcacatttattgatttgcacatgttgaaccaaccttgcatcccaggagtagggcctacttgatcgtgatggattagttttttgatgtactgctggaatcaatttgctggtattttggtgaggatttttgcatctaggttcatcaggaatattggcctgaagtgttgtattttcactgtgtctccgtcaggtttgggaatcagaatgatgctggcctcgtacaatgagttagagaggagtcccagttcctcaaatttttggaatagtttcattagggattggttacagctcttctttctgtgtctgatagaattggactgtgaatccgtctggtccaggcctttggttggtaggtcttttttattactgattcaagtttgaaactcgttattggtctgtccagggattcagtttcatcctggttcaatcttgggaggttgtatgctcccaggaatttatcgatttcctctgggttttctagattatgtgcatacaggtgttcataatagtcgctgaggatttttgttgttgttgctgcatttctgtggggtccgcagtaatgtcacctttgtcatttctgatggtgtttatttgggccttctctctctttctttcttttccttgtttgtctagctagcagtttgtcgagcttatttattttttcaaaggacctttggttcctttggtttctttgaccttttgtagggtggttcacatctcaacttctttcagttcagctctaatatttgttatttcttttcttctgctagctctggggtcactttgctcttgtttctctagttcctctaggtgcgatgttagattgctaatgtgagatctgtctgactttttccatgtaggcacttagcaccataaactttcctcttaacactgttttagctgtgcccccagagattctggtatgttgtacctttgttttcaatagcttcaaagaatttttttgaattctgcccaaattttgctctttactcaaaagtcattcaggagcaggttgtttaatttccatacaattgtttggttttgagacatcttcttggtattaatctctattttcattgcactgtggtccgagagtgtggctggtaatgatttcaggtttgtttttgaattttttgagaattgctttacggccaaacatgtagtcgaccttataatataattgattggttttgaaagatctatatataattgtttgcctctgagagatcttcctgctacagatgtctatttttattgcactgcggtctgagagtgtggctggtatgattccgggtttgtttctgaattttttgagaattgctttatggctgagcatgtggtcgaccttagagtatgtgccctgtgcagatgagaagaatgtatattgtgttgttgtttcgtgcgatgttctgtggatatctgttaggtcaattctgtcaagtgttgagtttatgtcccgaatatctttgttagttttctgccccagtgatctagcactgtcagtggggtgttgaagcctcccactatgattgtgtggttatttaagtttctttgtaggtctctaagtgattgttttgtgaatctgcgtgctccagtgttgggtgcatatatattaaggatagttaagtcttcttgttgaattgaaccctttatcattatgcagtgcccttctttgtcctttctgatcattgtgggtttaaagtctgtttcgtctgaaataagaacagcaacctctgctcttttctgttttccatttgcttgatagatctttctccatccctttactttgagcctatgatgggtgtcattgcatgtgagatgggtctcttaaagacggcatgcagttgggtcttgcttctttatccaacttgccactctctgccttttaagtgggggcgtttagcccatttacattcaaggttaatattgatatgtgaggatttgatcctgtcactgtgccgttagctggttgttatgtagacgtgattatatagttgcttggtagtgtcagtgggctgtgtacttaagtgtgtttctgtggtgacaggcaacgaccttttgtttccatgtttagcgctcccttaaggacctctggtaatgcagatctgggggcaatgagttcccttagcatttgcttgtctgaaaaggattttatttctgcttttcttatgaagcctagtttggttagatatgaaattcccagttggaatttcttttctttaaggatgctgactattggctcccaatctcttctgacttgtaagagttctgctgaaaggtttgctgttagcctgatggggttccctttgtatgtgacctgccccttctctctggctgcttttagtggttttcctttcaccttgaccttggagaatcttatgactatgcatcttggggatggtcatcttctgtagcatctcactggggttatctgactctcctgaatttgcctctctacctgtctagcgaggttggggaaatgtctgtgggcaatatcctcaaatatgttttccaagttgcttgctctctccctctctttgtgggacaccaatgagtcataggtttggtctcttcacataatctcatatttcttggaggttttgttcatttttgttaattctttttttccttgttttagtctgattgatctgattcaaacaactggacatcaggatctgagattatttcctcaggttgttctagcctgctgttaatacttctgattgtattatgaaattcttgtagtgagttttttagctcaagcaggtcagtttggttctttcttaaaatggccatttaatctttcacctcttgtattgttttattggattccttatattccttggctgccatgtcaactttctcgtgaatctcaatgatctttgttgccatccagattctaaattttatgtctatcatttcagccacataggtctggttaagaaccattactgcagagctagtgtggccatttggagacaagaagacactctggcttttagcattaacagagttcttgggctggttcttcctcatctgtgtgggctgacgttcctttaatgtttgaggttgctgtcctgtggatgggcctttttgcttttacattctttgatgaacttgaggttttgatgtggtataagtcaatttagtcaattggcttcatttctggatgattttggggaaccaagacacagctcagcgctcctgggctgcatgctctacccctgggggctgggacgtgtccatggttttttttgtttgtttgtttttgtttttttttttttttctggactctgaaggtttactgcctgctcttctggaggggctgaggtgttcccattccgctggcaacagcactctgatgggatgttccggccaaagtacttccgtggggcagcggtagggcagcaagggcccccaaatgcatgggctcaccagcgaagcagtgcaggaaggctatgagtgagagtgcatcggtggaggagggctgcgggagggtgcacttgtctgcaggggaccacctgcagaagatccccaactgctaggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtggtgaggcttggggttgggtgcccatggccatgcttcagtgcagcttttcccatgctaaaccctctggactccatgcaggcaagatttctatctctgccagctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcagggtctgtgtccttcctccatccattttcaatgccttctttccaaagatctgtttggaatgtgctggtcttcttgatgatcgggtctcttattgggaggagttcttcctgtctgcatctggtcagccatctttgccccaaagccttcagtaatttttaaatctgagaatgtgttaattttccccttcatttttgaaggatggttttgctggatatgtaattcctgcttgacaggtttctccttttttagaactttgaatatatcgcctactgcttgaggactacatatctcttatgagatacagtctccttactagttatagtaaggagttatcagtaataggaattatcagtaatcaaaaccttccaacaaagtcaagtcttgggccagatgacttcattggtgaattctaccaaacatttaaagaagaattaccaccattccttctaaatctcttccaaaaaattgaagaagagggaacacttcctaactcattccataaggccagtgttagttaccatgataccaaagtctgccaaagccacaacaagaaagctacaaagcaatatcccttatgaataccaatgttcagaatcctagatgaaacgctagcaggcagaaccttgcagtatattgaaaggattacacacccatgactgaatgggaataattgctgaaatgcaaagatgattcaacacatgaaaataaacccatgcactatattaacagactgatgataaaagaccgcatcaccatgtcaactgatgcagaaaaagcacctaacaaaatccaacatggttttataataaaaaccctcaacagattaggaagagaaggatacttccttagcgtgacataaaccatatatggaaatacctatagctaacgtcatactcaatggaaaagactgaaaggttttcccctaagatcgggaacaggacaaggatgcctgcttttgtcacttctaactcaacatactattgaaagctctagacagagtaattaggcaagagtaagaaatagaaggcatctaagatggaaaagaagaagttatcccctgtcacagacgacatgatcttctatgtagaaaaccctagagattccacaaaaaaagctgttagggctaataaatgaatttgtcaaagttgcaagatagaaaatcaacacaccataaccagttgcatttgtgtacactgacaatcaacagtccaagaataattaagaaaataattacatttacaatagcacgaaaagaatagaatactcaggagtagacgtaatcaagacatttaccttgagaactacaacactgcttgaagaaattaaagaagacataaataagtggaaagatgtcctgtgttcatgggttgtggttaattttgcgaaaaagtctttcctgctctgaggacataaacttaggcactctcgtaattgttctaacattttttaaaatttcaatagtttgggggcatacaggtggattttgattacgtggataagttcttcagtggtgattcctgagattttggtgcacccgtaacctgagcagtgtacactgtacccaatagatagtcttcttttatccctcaccctctttccacctttccctccgagtcccctaagtccatcatgtcattcctatgcctttgcaccctcataggttagctcccacttataagtgagcgcatacgatattaggatttccattcctgagttacttcacttacagtagtggctttcagctccatccaagttgctgcagaggccattatttcgttccactttatggctgagtagtattctgtggtgtatatatgccacatcttctttatccactcgttgattgatgggcaataaggttgcttccatatttttgcaattgtgaaatatgctgctataaacatgcatgtgcttgagtctttttgatataatgacttgtcttcttttgggtagatacccggtagggggattgctggatcgaatggtagttttacttttagttctctaaggaatctccataccgtttcccagaatggttgtactagtttgcattcccaccagcagtgtaaaagtgttcccttttcaccacatccactccaacatctattattttttgactttttaattatggccattcttgccggagtaaggtggtatctcattgtggttttaatgagcatgtccctgataattagtgacggtgagcattttttttcatatgtttgttggctggttgtatatctttcttttcttttttttttttttttttgagaattgtctattcatgtcctttgcccacttttggatgggattttgcttttttcttgccgatttttattgagtttcttgtagattctggatattagtcctttgttggatgcagggtttgtgaatgttttctcccactctgtgggttgtctgtttactcttctgagtatttcctttgccgtgcagaagctttttagtttaattaggtcccacttgcttatttttgtttttggtgcatttgcttttgagttcgtaggaacgagttcttgtaaatttgtttgagttcattgtagattctggatattagccctttgtcagatgagtagattgcaaaaatttcctcccattctgtaggttgcctgttcactctgacggtagtttcttttgctgtgcagaagctctttagtttaattagatcccatttgtcaattttggcttttgttgccattgcttttggtgttttagacatgaagtccttgccgatgcctatgtcctgaatggcattgcctaggttttcttctagggtttttatagttttaggtctaacatttaagtcttcaatccatcttgaattaatttttgtataaggtgtaaggaaggaatccagtttcagctttctacatatggctagccagttttcccagcaccatttccaaaatagggaatcctttccccatttcttgtttttgtcaggtttgtgagagatcagatagttgtagatatgtggcattatttctgagggctctgttgtgttccgttggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttacagtagttttttccaattctgtgaagaaagtcattggtagctcgatggggatggcgttgaatctataaattaccttgggcagtatggccaaaacaaccccatcaacaagtgggcgaaagatatgaacagacacttctcaaaagaagacatttatgcagccaaaagacacatgaaaaaatgctcatcactggccatcagagaaatgcaaatcaaaaccacaatgagataccatctcacaccagttagaatggtgatcattaaaaagtcaggaataacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacgtggaaccaacccaaacgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcgctcataggtgggaattgaacaatgagaacacatggacacaggaaggggaacatcacacaccggggcctgttgtggggtggggggacgggggagggatagcattaggagatatacctaatgttaaatgacgagttaaggggtgcagcacaccaacatggcacatgtatacatatgtaacgaacctgcacgttgtgcacatgtaccctgaaacttaaagtataaaaaaaaaaggaatgaattcattacctaagccaatgtctgcaagagtttttcgatggtatcttctagaatttttgtggtttcaggtcttagatttaagtctttgatctatcttgagagttgatttttgtaataaggtgagagatgaggatccagtttcattcttctgcatgtggcttgccagttttaccagcaccgtttattgaatagggtgccctttcctcgctttatgtttttgtatgctttgtcaaagatcggttggctgtcagtatttggcttcatttctgagttctttattctgctccattggtctacatacctgtttttatgccagtaccatgctgctttggtaactatagccttgtggtataatttgaagccaggtaatgtgatgcctcctgatttgttctttttgcttagtattgtgttgattatgcgggctctcttttggttccacgtgaatttgaggatatattttttttctagttctgtgaagaatgatcatggtactttgattggaattgcattgaatttgtagatcgctttgggcagtatggtcattttcaccatattgattccacccatccatgagcatgggatgtgcttccatttgtttttgtcattgatgatttctttcagcagtgttttgttgtttttcatttagagacctttcacctccttctttttccactaaggtttcttttttttttttttaatttctggaatttatattgtgtatggagtgagatagcaatctcctctctaaaaaatgggtataaccaatggatccagcactatatattgaatagcctgtcttttcttcagctaaccttcaatggcaaacctctcatgccacgttttcctatatttaatgggctctctatcctatcaattgtattggcctagatgtcatataagtgaactatcttaactatcttaattattaaaacttgatatcttgtaagccatgtcccttctgatcccctctactttgttttaatattcttggatattaagcgcccttggtccttcagtatgcattctagagtcatagagtctattgttccgtagaaagctgtgttggattttttattggaatcacgtcaaatatacaggttaagtggagaaaaccgtcatctttatcatagggattcttccatgagcatgctttatatctgcctaatttggaactaatagctctcgataacatttgataattttctcatttaaagtctgaagcatctttgttagacttatttccatgtaccttactattttgtggcagttataattggtgttcattgaagagttgtttttcctctaagtggttgttgctggtttgtaggaatacagttgattttcttcttagctgtaattaatgctgagagtttgtagattatctcaggtttttccatacaggtaaataatatattgtctatatagatatgatcgtttgggtgtttttaattccaatcattatatcttttatttattgcactggctagaaccgccactgttgagcagaaatgacaatattgagcaaacttgtcctgttcttgatttttaaggacaatccatgtaaatcttcaccagtgtgcacagctgttggtgcagattattttgtagatatgtgttttccatctgttttttcccagtttggcaagaattgtgttttggtttgtttttgtgtgttccgtgaacaggcactggattttatcaaatgattttaccctgtccattaaaatgatagcccaatcttgtttctttccattaatgggatgatttacattaacattcctttctaatgttaaggcatttttacactgctgtgatacaccaaacttgttctggtttattatcatttctgtgcgtcacttaagtctgcagtatttaatttagcatttagcttgaattataaatttcctttctcctattatacttacctcattttagagtcaagattatcctcataaaatatacttgggagtgtaagcttttatcttggtctttggtgaagtttgtatgaacttggaattaattatctactccttgaatgtttagtggaattttccccgtgttcctggtagttttcttgacgttgttttttttttttttgaactaaagatctattttttttaatgtcaacttttatttttagatagaatggttacacatacaggtttgttacatgggaatattgtgtgatgctgaggtttggggtgtggatcccatcacccaggttttgagcatagtatccaataaataggttttcaacccatatcccctccctgccccctcgagtagtccacagtaatttctttaatcgttgttaagtctagtcaagttttctatttcttctatagttagtttaggcaggatatgtttctctttcaaaatttctacgttgtctaggcattaatttatatcagtatgaaattgtttttggtattatcttgtttattgtttatgtctaatcatattctgcttgttaatttttaatattgttcctttgtgttctctctctctctcctcctgtccactgctcttcatctttctcccttcaccagtattgccaacgttggctgtttcgtcagtcttttcagaaaccaacttttggtttggttgattttgttgattctctctattgtacttttctttctctctttctttccatatatatatatatatatatatatatatatatatatatatatatatttagttttgtttgttttttttgttttgttttgttttttgagacagagtctcactctgtcacccaggctagagtgcagtggcgccatcttggctcactacaacctccgcctccctggttcaagcgattctcctgcctcagcttcctgagtagctgggattacctgcgcgtgacaccacgcctggctaatttttgtatttttagtagagacggagtttcaccacgttggtcaggctggtctcgaactcctgaccccgtgatccgcccgcctcagcctcccaaagtgctgagattaccatgcccggcctctattgtacttttcttttatacctcattgctttctcgcctcatattattttttctttttatttttctgcttttcttttgctcttctttcaagcatggatatgactctacacagctgcacccaggggtgacctttaaagacagtgcagagaaaagtatctccctgttgtggggtggggggacgggggagggatagcattaggagatatacctaatgttaaatgacgagttaatgggtgcagcacaccaacatggcacatgtatacatatgtaacaaacctgcacgttgtgcacatgtaccctaaaacttaaaggattaaaaaaaaaaaaaaagaagtctgttgaaaagatacactatggaccttgggctcaaagacctacggtaggaagctctgagtaggatgtgagaaaaatcaatgtgacagtgaaaaacaattattatgtacaactcttttatattctaaagaagggggttaagaataaagatccttgatgtgctgatcagggtgatgagtctgaggattcagtcatcagaatctcacagagataaatggctccacagagaaaagagatttgaagggaatgagactgttcaggaagaacaggagctgatgcccatccatctcatgagggtatgaggaagagaggcaagatagtctaacgcagactgtttggtgacatttcactgggacacgtgccattgaatctcccccgtttgtccccatgaagacgtctacaaatgcgcattgaatgttttggtaatcagatttatcattggtttgggggtggggggtgaatttcagcatctactgtcaagcggggcaagagcaaaggtagctcttggcgccctaatagtactctgcttcaataagttagctgtggtcattgcaaattatgtcagcagaagttgagtggttaaacatgggctttaccttcagagaaacggaacaattctgaaaaagaagaaaagagagaagatccaaacttgccacaggcacatgcagcaggttctccagtcctctttagagtggtttagctgtttaaaaacattgggtgggttctggcacgtgcctagtgttttccactcttaccctgtttatgcacctctgtcctgcttccttgatcagctgcccaccagtcctgagattctcccaacatggatcacttctcagtcattgagaagggaatatgagaggaggtctagatcattatgttcttatttggcagtttaattgttaaaaggaacattcaccaatatactcccacctcgacacccacagaacgtaaaaataaactgttgtaggatgtggtacagtggctcttacagggtatactagagaagaatgaggatgtgaagaaaactggggttcacattgagcctggggtggaaatcctggctgttcagggtggtggaaagtgtagggctgattgccattcctatgatgccttccttgaatcctccggtaagtatccacatcttctagtctctgacttcgaccatatttatcacctctaataccagagttctgaagtttgtttcttgctggattagtttctgtggtcttctaaggacttatgacctatacgtctgttttatagcctataaaattttgctaacatatttttcttggtgtggtgtcgttgtctggtaccttctgattttttgtcccgctttgcaccccccgcccccccccacttcattattaggggttttctggtgggagcataaaaagcatttgcactcagtattcctgaagtaatcagaagtaaattgatagattctctaatgttccactaccctttcattcctggaacgaacgcttttttaatagacatatactagttaagtttagtaataattaatttagaagttttgcatctgtaattatatatactataatttttactgctcgtactgtcctttttgaactttcagtgtctaattttaccagcctcatgatagagactttaaaaataatctcattgactttactgacaaatgtcttattatgtctgaaatataatggatctagaacctgaaaaaattagttaatgaaatgcactgaaatgaatggaaagtaggatactcttctatggtttttaaaaattgaggcatttactgagtcatatagtggcccccgccaaattcctgtccaccctgaacctgtaaatgtggcagtatttggaaatagtgttttttcagacgcagtcacattaagatgagatcatattgaaccaggcagggtaggccctaactccaatatgactgctgtccctataaatagaggtagatttggacaaggagacacagacacataggggagtcgcgtggagacagagacagagactggagtaaggcattacaaaccaaggagtgacaaggagtaccagcatccaccaggaactaggagagctaagaaaggcttcttccgtcagatggagcatggccctgctgacatcttgattttgtacttctagcccccagaactgtgtgagaataaatttatcttgcttttagccacccagtttgggtattttgttatggcagccctaagaaactaatgcagattttagtgctaagacgtgggttgttcctgtcacaaatgcctaaaaatatggaagtggctttgtaattgggtaatgactagaggctggaagacttgaggcacatgatatgaaaaccctagattgccttgaagagaccgttggtagaaatatgaatgctaaaggtgattcttgtgagagctccagaaggaagtgagaagagttgtagaggaagtgcttatcatcttagagaacacgtgtatcattatgaacagaatgatgctagaaatatgaatattcaagctgcttatgatgccgtctgagatggaaattagacacatgttaatgagcactggaggaaaggtgacccttgtgatagagtgtcagaaaacttgaatgaattgtgtagaaagcaggtcttgtaagcgacgaacttggatatttagctaggagatttccatgcaaactctggaaggtgtggccttgtctctttatagtaaaacgtgagagtaaagagataagttgaggaaggaactgttaagccaaaaggaagcacgcttgatgatttggaaaattcacagtctacccagatagtgcactatggaaacagggccaaaagtgtggctgaacagccatttgctaatgagactagctaggcatgtggacccaaccaaccaccttggccctaagccaggaaaccagataggttaatccaggaaggacccacacagagcctacatatctagttgtgtggatccccttggcatctgcaaaaacatggcaaggattttgagagttttatactagcagaaacgctgccagcctggactgaaatgtccagagatgggacaaaaatgaaagaagaatgtctctgaaggcagaaacatggaagaccagaccagaaatggcattgtcattaccctggagggctggatggactgagtccctgacccagaaagccaggaagatggggctgcctccctggagggtcctaaagtttggggctgcctccctgaagggcccttgggacagaagattgagccatggaagttcactctcggcctgaaacttaatggacttttttcctgctgggttgtgaacctgccccagagcgacaacccctttaatctttccaccttctcccttttgtgaaggggacgtctaacctacgtccgtcccactgtagtattctggaagtagataacttgttttctagcttcatgggtctgcagacagagaggaacattgccccagggtggaccttgcccaaagtctactcggtaagatcctgacaattttagatgagattttggatttagggttaatgctggaataggtgaagatctggaggatttggagatggggtgaatataatttactcacggtaagaatgtaaatattggggagccagagggcagactctattgggttgaatagtgcgtgcacccccctccccaaatttatgtctacctggaatctgtgaaggtgattttaattggaagcaaggtctctgtagatgtaatcaagtgacgataaagtcacactggactagggtgtgccctaatccaatgactggtatctttataagaagaggaaaattgggacaaagagacagacacacagggagaataccatgtgacaaccgaggcagagattagggttaagctgccacaagccaaggaatgccaaggattgccagcaaccaccagaagctaagagagatgtgtggtacagattctctctttaactgccaccctcaccacaaggtaccaatcttgctgacaccttgatttcaaacgtttggccaatagaaatgtgagagtttaaaattctgttgtttcaagccacccgtttatggaaatttgttatagcagcctgaagaaacgaatacagcacttgagtcctgtttagcaaggatcaagctagagctctttggtcactgtgtctagcctggtgaacatcagtggctgcttggggcagccatatggacattatttgtgattgtgcatccctgagatgggcctggggatgagcccttgtgagttatgcaaaaaaaaaaaaaaaaaaaaaaaggaaggaccccagcaccccagggagacttaagcatggcaccaagttgcctaacagtcattgtttttcaggcatgggtaccacagttgctgccgtagcatgcattctccttaccctcaagcgtattcatgtgcatagccatggcagccggtgtcccagggactgatgattaaataaagagggtggtggaggaggagcgtttggcactcagctgctcccacagtgctaaaccacttagcccttattctatgcagagctatatctaagtttcatttaattctcacgccaaattgaggatcatgatggaaaattttgtctatagctaaatagaaagctgaaactaagaaaggtcaagtatcatgaagtaaaagagaggttctattagtaatagcaaaaacttggacttcaagcactgtgttcctttcatttgtttttaaattttatttattttttaattagacaaaattgtatatatttacggggtacaatgtggtattttgataagtgtatacatttagaaagactaactcaagctaattaatatatccatcatctcacctacttatcacattttgtgttaagaatatctaaaatctacttttaaagcaatattgaaatatatgatacgttgttattaactctgctcactatgctgtgcaattgatcaccaaaacatattcctcctgtctaactgtgctccagtcccaaatcctcagcagtaaaatgcccctgtctctcctcagtgaaaccactcttgattaataaagtagtcttagtgtagtcttacctggggcttagttgtcccagatctttcctgccatccaccagaacctctttgcctgtagagagtcttctgaacttgagaagctgcaggattatgaaagcccagcatgtcatacacttgcctgctcattgctccttctctcaccttggctctcttgtctctcatagcaatgtcatctcaatatcgggcatcatgaacataactcttccggcctgtcacagaaatgaagcaaataaactgatggaaaaaaaaccataaagaaacccacaataccagccacaagtcaaaccatttaaaactgttacttttgtattagtatcagacaaaatagacgttaagacaacaataattatttggaataaagaaggccaccatgtagtcatgatagaacatttatcaaagagctaaaaagtctgaacttaacatgcactcaaaaacatagccaagaaatacataaagcacgatgttcagagttacaagaaggttgccacaataaaatataaaagtgcactattttagagttggggcagttccaagaagtagcaagatccagggagtgcccctgagcatggcagtcaaataagaggtcttgcgaccatgaggcttggaatcagactggttttctacatggacattgaaatcacccaggactgtgacaagattaggtgtagaaactctgaatgagacataaaaatctttgaccaaaagaccaatacgttggttttattttagaaagccatctttgtaagatgcccaggatggccataaaattgaatgtgtattggtcagggatatttaaactacaactaacagaaagtgcaagtctcgctggcttatccaataggtaaagacacttgcttatataactgagagttcagaggcagagtgagtttcatggttaactgagccagtaacggaaagatgtaaacatccaggctaaatcttgacccaaccactgctggattgggcattggattattggattagattagactaattctgggcccactcttggagctaagaaagtggccatatatcctcaagcacatgactctactgggaggagatacactgatggaggcctgagcccagccaggaaggtgaggaatgtatattgtgtaggtaaacaaaaatgtcacctgcaggtacagactcaaattatatataccgctatgagcatagtaaccacaatattcaagtccttcttgtgtcctaatagagtgactcttcgggtaacaaagacggatattttattcaggagctacctatattgaattcatgaataggcggttacaaagcatgagagctctcccctgtgcagtatatgttttggaagaacctcaacaggcatccactgtgggatgcttaaatcccattttcattctttttcgattcgtcggcaaagttttctattcgctcttgtcctgagatgatgttgtgttaggattatttgaccagaggtaactgaattcttcgtatttaccgttaagttttgtctttctgtaaacacgcgacacagacttcacaaagatatcaaagatcctcagatttcagtatggaacaaccttaaaagccctgggtctttagaagaaagtcagactcagccaggcgcggtggctcacgcctgtaatcccaacactttgggaggccaaggcgggctgatcacgaggtcaggagatcgagaccatcctggctaacgtggtgaaaccctatctctactaaaaatacaaaaaaattagggcttggtggcacgcgcttgtagtcccagctactcaggaggctgaggcaggagaatcacttgaacccgggaggcggaggttgcagtgagccaagatcgcaccactgcactccagcctgggcaacagagcgagagtccgtctcaaggagagaaaaaagaagagagtcagactcctataatgtaccaaaattaaagaacaaccttttcctctaatgcacacatttattcacgctttgaaaagaatatgtttccataacaataccaaatatgcatatgaaaagaaaattaaaaataagataatcacccaatctgcgaatatgcagatttgaaaattaattatcaatatataaatggaagctcttaataaagacgttgtagtatcacatagacaagatatgtaatgtgttattgctcatgttttgccttagtctgcatctacactgtgaaatgagcttaatcgtgttcactggttcattatttgctaactccttgattgacttagccagttgagcaatccagccagtgagtcattctataactgttgataaactacgtgatgttttaaatccaaggattaaaagaaaacacaaacattatatatcttgccttttttcacaggatctaatcactgataataaattatcagtgataagctgatcacaagaaacaaggtataaatgctgcatacactaaaaagaaaacaatgtggctgactatgttttaaaaattatctgacagtattttccaacagagtatttagaactatttcttgaattgcaaaatatagttgccttgagcagataacaggaagcaatctgggaaatttaaaattctctacttttaatacattagaaatctttgaatcataattgctcattgttttaaatggtcttcacagtggagggggtttggaccagagagctgcatcttcacaaatggcactgctcttcagtaaacaccctctatggaatccctaccttttcactcctctccatcctttgcctgaaggaagttttccttgtagacataattttgtatttgtatgttgtggtagtcctcaaagagtgagcctattacctagagctgttgaattttaccttgcattgaggggttggcatattgagcaatttgccagggagcactatctgcaactgcttctctttttttcctattgcttggcactgacataaagttacttctagctacgctaatgaatttcacgaaggaacacagaaaaacaggtcttgaatgtaatgcccgtaatgatagagtcccatcttatgctttcccttgtatgctgttgctaggtcagtcatttttactttctgaaagttaatttacataggacacctagttcaggtgtatgtatctgttcaaaccaaaagcgttagagtatttatgtttaatttaacaacgtcgcaaccgttctgatacttaggggagttctgagtaagtaagttctagaaaggggagttccagtactcccctttctctcttttctgtgttaggtaaagccacccctcctaaagccactagcatggatccccaaaatgtccaccacagaacgaaaaggtaaaagaaggagaagttgttcctgttaaatcctgccgtatcacacgcaagagaaatggcttatcaacctgcctcaccccagtaaacacagcgcctaataaattcagtgcctaaactggaccccggacatatgaatctttgtccacagagttaccttcccccactgtttgtgcatattagagcaccgacagacttccattggtgtaacttaaaaaaaaaaaaatcctaacaaagtcctgataatcatctcagagaaagagtgaatgatatgagtatcaggtctgacaggagcaaactgtgaattaaagtaagagttataattaggatttgtcttttggtgaaagaatttgaccatcatcaataccgtgtaagttccagttgagcataggtgggctagataaaattgtgctgtgccttttactggtgatctgttcatctgtatgtaatgatagaaacgggggccagggcagataccaggtcttgaagtaggcttccatcctgtgactttgtatagatacttcctaaatccaacttgaaatttcataataggctctttcataaatatgtagccccattttatatcctctatttacatgtgtcccataaataattctccagaattatccgagacccactgattggcgcttcctagtcattcattccaattatcatgacttcagtctacggccataccaccgtgaacgcgcccaatatcgtccaaatatcatgacttcctttgataaccttagagccactaacacagcctgttgtcctcactagtatattcaactttaactgtggtggaaaatttggtctgttgagttttcttctgcttatttatgtagccaggccacagtgcgggaacctagcaaagtaatcccaatgcttgtatagcattgtttgcctctgcaagcaaatcagaaagactccactccaccaaatttattttggacatgcaggtgaagctgcagtttcccacacaaaccagcaaaacaggtggtcgtgaaattgcgattaacaacaactgcaatgtgtactctccttctcttttctctatcctttctggggagacacaggcagaataaaaatacagtgaaatctaattataattcagattccactcatacaaaattgttgcagttcaggccagagccaggtatgatgttttaaaagtgctaatctttctcttttcagtaatttttttaaagaaggaaatgttttcagctaacctcaaacattttatactgactttcatatatacatattttatatattaatggtaggtttatatgtatacatttaaatgaatctcctgaggtccttaattagattcagcattgactggtgctaattactgacagtacttgaaatttcttagttggtatttcaaagagaacatccaagacctcaactcttcagtaactgggtctggcttccagtttgtgtgaattaataaggctgaactaaaattaatttcctttggaaaacccgggggtggtcagaacagtctagcaccatactgcctgggggagacagctggtttgccacctgcaatgtctgtgacctcttaggcaagtgatttaacgcctctgtgcttcagtttcctcgtctgtaaaattctgttatactacctactccatagagttagcactcttaaatgcggtaaccttttggagtgtgtggcacatactaatcactatacacatttttctttttcaaatgaacaactaaaattcattaggtttgccctaatttcctttggccctgtatgaaattaagtaaacagtgcttacctgtacggactgcttaggctcttgcagtagtgtctatgattatggttttagtgaggaccttcttcattgtgaagtattaaatttcacgtgttgttagaaatgaaacacataaaatatattaaagagggatggggggccgggagcggtggctcatgctgtaatcccagcactttgggaggccaaggcgggcagatcacctgaggtcaggagttcgagaccagcctggccaacatggtgaaaccccgtctctactaaaaaaatacaaaaattagctgggcgtggtggtgggcgcctgcaatcccagctacttgggaggctgaggcaggagaatcgcttgaaccgggaggcggaggttgcagtgagctgaaatcatgccattgcactccagcctgggcaacaagagcaaaactccgtctcaaaaaaaaaaaaaaaaaaaaaaagtgaggtgagggtagcaaaagctcaagtctgtgtgctgtgggaggttatctggaggtaccaccatctcagtaatatgggcaatctcagagctccaggtctcatgaacagaacggtctcctgaaacatgcagatcaggagaactctgcagtggttggattctactgtcaggaagttgacccaagctcacccacctatcctgggtacttgagccttgcaggatcctaaggctgcaagccacgtggatgccaccatcatgtgaacactacaattatgagccctactgatagggccctactggtcatatcagcaccaagggctctaaaactttgaggtcatgtggcctctcttgtcatgttgctcctatggtcatgtgatgggcccagctcttccagtcactacagtatggtggactcctgaaccctgttgctcacatggattcttccctcacctggccattactggctaccagcatgtggaagtctcagccctcgaagtcatatagatgacctactgtttagggtcatgtggatgctatggtcatgtccactgctcccactcacccctccccatggccacagtgtcaggctcattcctctctgtcacgtgaagattgtgagctgccaaactctgcagatgtgtgtgtgggcagccaagtggctcctgtcatctcgtggcaggcaaagcctttgcggtcctgtgagcaccgcagctaaccaatggctgttgtacatgtggctcttatggtcacgtgagattccgcaccctcccattcacgtgaagattgagtgctccgaatcctgtcagagaggtgcttccggctccacaccctgactcaggcggaagttttattggacttcggctcagatctgaagccttccggcaactttcatatcctgacgcgctggaaggaagtctggtacgagtggaaccagccggtactagaagtttactgagaattgggctttaaggcgtggctgagcaatctccaaatagcagaggctctgagggggtggggtggggtggggtgggtggggggtgccgggggtgcgggagggtggggggtgcgggaggtgcgggagggtgggggggtggggagggtggggggtgcgggagggtcggggtgtatggggggtttgggtggaggtagcggaggacttccctaatgtggccgaacttgtgaacacctggcagagaaactgtgtgtgcgtgcgtgtgtgtgtgtgcgtgcgcacccatgcatctatgtctgccatccgccttgatcctggactcacaggagctgttgttggaggagaaggcactggggcagaatgtggggctgggggataggggtagggttggtagtggggcggcagggattcatgaactcgtaagtcgtttctcaggggcagggctgtggaagcctgatgggattccccccccttcccgcccccacactaaaagccctacccttgcctgtcactctgcccgattcaccgtctgtgccaggtgattctgtcctctgcccctcctcagaccatgttgttattaaggacactcgagactgcctagatcccagtttgtatagacgattccagacccaatcttaatttctgtctcttatttgattatgtaaagattctctttgtttccatgatttatttttctactaaaccttctaaacatgggctcaggggggtgggcgaaagggagagaggggaatcgggaatttttttaaaaagagaatttgatatttcaataaaagtgtccaagtcgtcatgatgtgaagattcagaatttacttgttatactttatttgaactccattggctttaaaaagtacatttgggagtgggtgacattttttttgtgtgtgtgtgcgcttaggatctctcagtagcttatagtagtatagcttcacactcttttgtttctgattctccccccatcaacccctgattttctaatgattgcttcttagattcctttctgaaaactctctccttttcttcctgtggaaaaaagtatagtgaatggatttaaggtacaatcatgggtgataacatttggtacatcatgaaagcggtattgggtgaatgaagttgagcaaatagcaagattgtgcttaaacttacggggtttcaaatattgcttgtcagatggttagagaatattgtcacttgtgatatttgatattacatgtaggttgaataatctatttttctctcatttcagcatttccaagttcgttctgtgagactgtagtgtcaggacaaagcaacaacaaaatgtgctctactctaaagaagtgtgggacatacagaactgaaggtaaacgaatactgtaggatttttttagatgatatgctaataaacaacacgagtctcaaagggggggctactttccccaacttgtatgggaatggaacatttttttccacagagcatttgaggtaccagtgttcttcagaaaatatttggggaaaccctgttcagactacatcttctaacactttaaaaccttgtgcctttgtttactcagaacaatggaatgtgggtttataatagttgtaatctagtctgctcattaagacattgattgttgctctttaattcattttatctcatgtcatcagtcagtctctcctgcttgaatctttgtacttttttactcttcagagataccgccaagcatgcatctgataccatggtggtggcagacaatatgtgcataaatgcaagtcattaggaagccttacctgtggcagcaaataaagtgcccccactcttgaaaacaaggtacaacttacctgtcaggacaagcagatgcagtaccgctcattttacacaataaaaaaccacacttcttcagaaccattttattattacttaataattacagctgccatagtttgagcccctgtcatatgtcaagcactgtgataacctcggctgtcatgcaagttactgcatttaaccctcaggaaagtcctgagagggtgttatcttaattgacagatgagatatatgagtcaggagaggctgagtgtaacgctgtgcttataggcaacccccaaacctcagtgacttatttctcactcctgctgcatgtttatgccaggtgcatatccttcacgggatggtggatgttgggttctgagccattcttattggaatgactcagagacccaaactaatggagcagccaccatctagaaaggggttactcactgcgtcagagtgggagagagccgtagagggtctcaaaccaacaaccaaaggttctgacccagaaataacccgtgtcactcgtcactcacaacccattggccagagctagtcacatgcacggccctgccccaaggaaggcagtcgggtcgggcagtcctaccaggtgcctggtacaggggagaatgtaaacacttggtaaatggcagcactgactactgcatgaaggaatcaaagctgggagggattaagtacttgcctaacatcacatcggccgtaagtgacagaatcaggatttgaatccacccaggcgtgatttcaaagtcgatgtcctttctgcttctttctacgctgcctgctcttctcttaaaggaagcttatagtaaaaattcttttacatcaatgatgcaatgccctcttccttaatcatctgatagtttaattgaatagacacgatggcactggttaaaaagaccagcactgataagccagaggtcttttccaaatgagggaatgtattggatatttgaatatccattgtattcaattataaaaataaaaccaggtggtagatgaaaggacttttcattgatcatttacttaatgtggaataatccccatgtcttaccgctatgttgaggaaaaatgataaaaaaatagagcctaccttgatgaaagtgaaaacaccatgtgagagagttgaacaaaattgctagatgtcagtgtttcagaagcgcaggataatgataaaatctctggccacacgggcagagaaaattagcgaggtggtgcgggtcagccacttttggaatgaagatagtgtcacacttacagtgacagaaaagattgaaaaagatcacattatgaaaaggatgtgaaaatttgaaaatttagattaaattgatgaattccaggggaaaaatatatataactttccaaactgaaggaatagaaaaccttggtttattcaatgtattcttgacaaggaatacatgcaaaggcaaaattactagccaacccgaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatcaagcgtatgtgccaacatgagactcagaggtggaactgaataacatgggagccatatgtggggtggactacccgtgatgagggaggtctccagttttcatgcggcagccattgcagagtttctagaattcagtctctgtcatgcatgtcaattaacgggcaggcagcagtggtatttcagctgtagcagttccatcacgtgggtggacttctcctggctgtgcagcatccaggcctgcttttctggccctcacagagtttttgtaagctatgtaatatattttattagagatatcttgtttgtataaaagagctagagtgaattctggcataggcaagttgggaccttgattaacagagtacttggcagcaaaattggttgcaagcaaaagaccttgaaggaaatggggatctggggtagatttggcccacagggcatagttgctgacctctaagctaataagttgctgacctctaagctaatagactcactgggtccccaaaacagtgctgagtgggaagtcagcaaaatgaggaggcagctattgctaggatcctctggcaagcataagccaaaaactgaggctttaacacggttgttttcaaccttggttgcacactgcaattcacatggagagttaaaaaatgtggttgcctggatctaaccacggttctgctttgattgttttgggtgtgtcctggtgctagtgaattgtttcagtgtccccaagtggctctaatgtgtaatcatggttgagaactgcttgaacaatttaaatcataagaatgcaagcctttcacaatatttaattttaaaattttataattgtggtttcagaatgataatattacagtaataataaatacatagttacgctggaaaatatgaaataaagattcccatgtaagacatcgagaagattgtctttttcaaagagaaaggaaatgggaaaacacagtggtaaagccggggccaccacaggttgtgtccggcttgaagctaaactgccggcaaggccagagcaaggtatggattaaagctaagtgtctgtgagcccagggctgattcagcagtggagcttcctctgcagaagacatccacaacccaggatcagcaaggaagggatggcacaaactcaacaaatccaataattggcactgagggaacagaaagaatggaagaggctgaaacagacattaagataatatttccccagagagacaaaggagtgataaaggatgaaattgtgtctattacgaaagaatagaagactgcccaagaaagatggctttttgaaggcaaggatctcctttcacttcctcctgaaacttcattaaaacaacatcaaaggtgaacaaattatggtatatccatcaaggggcttttactcagcaaggaaaagtcaagaacatggatgggtctcagaaacattatgccgagttaaagaagccagacccaaaggggtgcagcatgcacaagtccatttgtgtgaaatcctagaacaggaagatgaatatatagtaacggaaagtatatcaatgtttgcacggagccaagggatgaagaggagatcgactggaaaccttttgggttgtgttatatgttctatatcttgattgaggtggtagctagccctaatctctgatttttacatgtaaggaacctgggatcaggagaagttgaatgagtcgtcaaaagtgaggttagcttattaatcagagagaagatattcacacttgattgtcagtaataaacggtttccattatgctgtatatgggtcgataggaaaagtgcttctccccaagcacttgacaaaaccctgacccggccataaacatcctcttatacaagtatgaagcgtaggtgtgaaagtataaccattctgcattccagccacctacttctacacatggttgacattctcacgtgtccctttaccctgacttgtttgtgtttatatttacaaatgaaaacataacttctcattaatattttcttctgaggaatcatactgtaatatacagttttataacctgactttgtttttctttccctttgtatcacgtggcgtgacgagtattctaccttgttgcttatagtctgccacttaaacctgaaacatttcttgcataataatacatttttttttcctgaaagatcggaaacgggaacttaagctccctactgaatccttccgcataacctgtttcatgctctgagctttctgttttggttccctgaacccatatgtcagatgattctccactggagccggggctgccctgttttactactgccgctttgtaagatacattaatagctgacatggcaaccagatgccactcactcatctcttttccttgtcatttccaggaggactaataacaacgaatgcaactaacacgtatttctccctcaataaacgccagatgttgtactacgttctcgacatagtaatagacaacttatttatagtgcttgttaggtcacgggcatttctccaggtgcttttcacgtgtttccatgtgttaactcacttaatttttacagtagcccatgaggtagaaactgttactatctttgagttagggggaaaacaagcaaaaagaacttgagtcacagcgaggtcacttagttgccttggatcatagaatttagcaccaggattgaaatcctgatggatctgaccacaaatcctaggcccataaccaataatgtgcgactctgtgtcaaggctgaaatgagcagtacgacagggcccactcaaagtctgctgggcaatgatgggtgtggtttctggaaccaatgtcccgactccagccttctgtccaagagactcatcattgcacagtgttgccctataccatctctccttttttcggactgtgtgggaactgtttctctggtgttcaacttgaagtgaagtaacagggacagacaagatgtacatggacaggaaggaaggagggttttcagaggggagcatatcgccaggatgaattcagttccctggaggcgttttcaatgtgtgtttctttgtcttctctgtactcaccctcttctttctgacccacacatccatcccttggccttttcaccctgtatgtcaggtactcatgccccttccttgccatgtctacttcattgcaagggcagtcatttctacttctccctttgacaatatcagccactctctggtcccgtcatccttctgtcccaaaggacctgtaaagcacagccgtataattatatgtatatatttagacagagagtgatatatgtaataaattcgaaaagtgaaacgtctggatcaaagtgtaagaatgacttctgaatggttaggcatattgcagaaaattagactcacacacggttagtggaagtgtatattggtgtaaatatcattgaaaatccttacgaaaatatcactttatgcttaaaagtactcatgtgcttctcctgggaaactgtagagcagggactcaaaatcttaaacccacttcgaagccctggctgtgttccactgggttttttggccacccctgctgggggtactctgtaaccctggtcaacctgtgggtattgttccattacttttgtgtacagggaactctcctactttcttattttaaaactatcagttcaaatattaaaacaccgagaggtagaaaagaaaaaaagcactaaaaagcatattctgaacaagaaacaaaatttggccatatataatacataacacatgaaaagaaatgtgcagtgggatccagtgttgtgtggcaatgtgtttaccaacatgatttggagtacatgtatctgtaacctaattgtggaagcatgtaatacgaaacactaatacttgctcgcatgggcaacacggacacacagaccacacattcttccctttctctgagacagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggaggtactcagttctatttctaaggatacattaatgaaaaaatattaatgttgcagaagaaaagattaatttgttctagttttgcagtcaggttatgaaatagttctgcagcccgaatagctctggaataaatataaatagaggtcggtagaaatggttcagatggatgtattctcaaaagtggttttgtcgatgatcccaaacctacatcaaatgcattcatttaacaaatattaattaggcccttattctatgccagacactaccagcccaaagtgactcctaatctgaaaacccatggcccaaacagattacacccatctggtccaagacagagatctccaccttatccaagacacctggttcccaccccaacaggagtgactagcacaaaacatcatcccggcctgcttacaaaaaaatctgtcgatgagacctgaaagcttgccatttaagggagaaccagtgcagtctctggaggagcactcagggtatagaggcagaccaatatacgtgaggacataattcctgttctgccacttacctggctgggaaatgtacccgacatctgttaacccaatattcatgatctgaaaagggactgtggataaaattctcatgggatttctgtgaggaggtcaagagaaacctagtgagtctgcccaacactgagcagatgttggttgccactgggcaagggttggttttcttcttatcccgttctttccctgccgtagcagggatgctgatgccatgcactcagtggcatggcagtgatgtaggcagaattccaaactaacacaggaagtaccagtaggaacacacgtgatgtcataaaggttactcaccactatgtctgtgtggggggatcagccagtacatggtgggacttgaggggaaacccaggcggtctgggtgagaagtactagctgctttataatactcttgagatcgcccgtaattctggcagcacaactgcgagacagggattgtgctgagatgccagagttcagcaagtggatgtacgcctgtgtgtgttgtgtcttcggcatctctctctgtccggtccctctgtggctttttatcacatgtgctctcttccaacacaaggccttgcctgaggctgtagctgtagctgttggctagcttacacttttacaccttcttcccctcagtgacgttatttctgaagtaatgtgtgttctcaaaaatgactctgactcttcctgtgctccatatattgaccgtgtgcccttaaccctcactttaatctttgatttttttccctttcatttatggactttcatgaaaatgagttggtttctggacatcctccaaatgtcaccaataggggtctttgttgttgttgttgctgttgttgagtattgttatggactcataactttttaacatactgatgggctccaaaccgcggttaaaggattttgagtaaaggaatgacaagatttgacttatgccttaaaaaatcactctgcctcctgtgttgaaaatagatggtaggggagtcaagggcaaaagcaggacaacttggaaggcagcataatccaggagacagatgttggtgacctggccagggtaggtagcaatggagggggtgagaagtggccagactctggatatattttaaaggtagagccaagagaagatacatccatcctgatcggttggatgtagagtgtgagagaaagagagcactccagccccacttccaagttgtagggaccaagcatcaggaatgtctaggtcagatgctctgcccacatttaatttcacttctaatggcacacagggaaagtcccagcaatcgagaggagcaggactgtcctgacagcgggtcacacacagtgaaagcaatgatgccccctacagaagttcatctgaggcctggccataatcagtatattgcagagaggtcagcagtgaccgaaattttattcataagagtgccctgagacaaggtgtacattttgaaattggtcgaggtctgtttgatggtccaggagatggtctaccttcgtgaatgctgcaagacagtagagggggaaaaaacatacatgctctgtttttgttgttgggtacagtgtgttgggtacggtgttttatttatgtcatttagatcctgttactgtagtggttttcagtatctgctgattttctttccagtaattctgtcacttgcttaggaagagttgtctcttgggctgaaagcatttcgggctgggcaaaaagaaagcttgctctgggtatttcaaactgagtatttttgagggcaaggctggaggcaggagggcagcttgggaagctgttacatcggacccacctgtcattaaagctcgtactgcactggcaaagaggtatagcttgctgattgttcacagaatgcatttggggattggatttgggaggtgcgagagagcttgtctcccaggtgttggtgtggttgttagattagagaagcctgagagaaggcaagattaggaccccttccaggtgtgtggctggtgtctagtctaacccatggacacgcgcacctctgttctttataattcctgctccatttctcaggaggttcaacacagttgcttcctctcccaagattcctaccctgattgtgccacctgtgagataaggctcttgtatctggacaggcagaggagtttgttttctggggcttatgtggcgggttggcactttgctagccctaccatggagttagctcacgacgtggtacgtggtaagtggaccattgatgtgtctcaaacttgtctttttgttctcagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacagtgagtatcttggtggggtctgcattaggtggactattctggaacctgatagaaggaagaccacttaaaacaccctaagttgattatttggaggagagcttcggaatggggggaaagggagtttagggcatctatatttggcacaaaaataagaaatcatgtcagcggtcctttctttagaaatctaagctaagtagaaggttggaaagaaagaaaaaaaaaacccagctggttggttctgttctccatccttagttccacgttgtctctcccttccctcctatttcttctttttacccttagattccttacgggataaagtatgacaaggcatggctaatgaattcaatccagagccattgcagtgaccgcttcactccggttgatgtaagagaggatggtgaagccagatgagtgggcatgggggacggggagaggcctggctcagcaggggccattggcctctgacgctgttgctcttgccttcactccctgtagttccactacgtccgaaatcgggcatgcttctttgtccaggatgctagcgctgcctccgcattgaaggatgtcagttataagatttatgatgatgagaaccaaaaggtgtgtgccgagggcatgccctgtacttagtctctgggcaggaggacaggccagggggctggtcatcctctttgggattagaggtcctggtacttaccaccctgccttcctgcagatatgtatatttgtcaatcattctactgcgccctactctgtgaagaataagttgaagccaggccaaatggagatgctaaaggtaatacagactcaaggatcattgtatgtccacttcctggacccacctcttcttcccctggccccctctttccctgtcaccacaccaccaccaccaccaccatcaccagagccccagagcctctgtcttcatctctatctctgcagctgaccatgaacaaacggtacaatgtctcccagcaagctcttgatctccagaatctccgctttgacccaggtaaggctgacagcagcaattctaagacaagcgggggcagagaggtctgcctgggagggagacttaggaatggcaatttacagaggggttggggctggctctggtccagccagggccctcccagccttccgattcccttctcttggcttcttcaagacttgatgggccgtgacattgatataatcctgaatcgaagaaactgcatggctgccaccctgaagatcattgaaagaaatttccctgaggtgaagccttaggctcagtgctggtatttagttagaggggtggaagggataaggtggagggcagatttgtctctgaggcccaagatagtagccgccactctaactcttcttgacccaaagctgttgtctttgaacttgtgcaacaacaagctgtaccagctggatggcctttctgacattacagagaaggctcccaaagtcaagaccctgaatctctccaaaaataaggtgagaagggggagccagatcaactttgggtggagggcaggacacatcaggataatggcaacagccaggcagtggcacctgtgggtgactatgagggccgggggaattcagggcccagggtcctgggtgtctctctttccctggccctccttctccagtttcctccccatctttcttagctggagtcggcgtgggagttgggcaaggtgaaagggctgaagctcgaagagctatggctagaagggaacccgttgtgcagcaccttctcggaccagtccgcctatgtaaggtcagtggcaaccccggtcacccttcctgggcacctttgctccctgggtgactgagctgtgtctgaaggtgcccttctgcaggaagaagcagccttggtcctctgggaggaccacagacctcccttcctactctctctctctctctctctctcctctctctctgtcactcactcatctgtgcttagaggtctcctttccttcctctgacatggtccccttttcacctgctctggggtgtgtttcccgcctgtctccaccaagcctcctccagtgtgccctctgtgagtgtgctccaggaagtggggctcccccacctccccaggaccagcagtattcagatgctggtgccctggaccgagaagagtcctttagtccggggcttcatgctgagacaggccttcctgcctccatgctgcgatggggcttccctcccctgtcccaagaggggttctccttctcttgctccaaaaaggtccccccacctgtcctgggctggcatgggggcttccctgccccatactgagggctggggccccgggtggctgctgtcatgccatctcttcctctggcccaatgccaggagctgggccctccttggggagaaacctgggtttcctacgtcaaggggccagaagcgggccacgttcctgaggcaggagtggaaggcagagggcagaggaggttgagaagacagaaggacaggcctctcaggcactgccccaccttccctccttctccacctcacatcgtcctgcctgggccctcagaggagccctgggtagcccgagatgggtagcattcctcggtcaaggcgtcagcacagaggggcacaggagtcagggaccatcagaagagaatgcagtggtctggagagggggtccccagactctgaaccccatgctgagctggggcctgactcttcactcctcccgggagaaggtctcctgtccccgtggctgctctgtttcccatgcccagctcagactgagctcacacaggtgaggaaggctccagctgcatccagtgggccccagcccaacaggcgcatgttttcctttcctgcctcggtccccagggccagccagggagcagtgagggaaagggctgcagcaggggagcccttttctcctcttctcctccctgaactccacctccgcagtagagagtctttcccttccctttgcattgcatcctgtttctcccttgtctctcctctcctatgtctcacccatccgtccctcccctaccttcaccccgtttctgttgttgtcccccctgccttccgcttcctgcctcctgagtccggcctcactcacctccgtgtcccagcatcctgggccatccctaagggctgacctggtcttggccagggcctggtcaggcaggttgatggacagccagtgaggtggcagagccctgggctcccaccccatttcctgctccctgcagagccttccatggtgacttgggcaaaggggagggagggagaggaagaaagccctggagcctgggctcccagtgctgcttcttgtagcactggagaaaagggagtcaggacagtctagatggaagctaaccaggaggaaggagagggaggagtgtgagagggagtgggagagagactgtgcaaccctgaactgtcagtcacttcattcaatttttggttttggacagtgccatccgggattgtttccccaagttgttacgcctggtaagtatgtataataccgtcatcattgtctcctcttactcaagaaaaggacctccacgcctgccctcaagtcctttgggtcttgcctagattacatgcttgtatcagaccctcatccattttacaggcatggattcctgaaaaagacaagaatattctccctggaaaatgtgtccccccgccgccaccccccccccacacacacatttgcatgtgatagtagagatgtccagcaccccatgagaaagccacccactggaatttccagggccatttcccacctagcctctgatgcttgtctccctgggcatgttcatcttatcgatcatccagctccatctccttggtctccactgctgacttcctctttccttctccaggacggccgagagttatccgcaccagtgattgttgacattgacagctctgagacaatgaaaccctgcaaggtgaggaagaaggaccaagcaagatttgggttgctgtaagggaggctttgtccaccgcatagatccaaattgtcttttgatttcaggaaaactttactggatctgagaccctaaagcatttagtcctgcaattcctgcagcagtgagtatccctgggaccatgaggaaggggagggctgagacaggctgggccacccgtgcagcctgggagttttcaagtctcatctggggcccaggccacagagatagcctatcctcactgcttccccacaggtattactcgatctatgactctggagatcgacagggtctcctcggtgcttaccacgatgaggcctgcttctccttggctattcccttcgaccccaaggactcagccccgtgagtatcacggctcagaccctgctctggggctgtgtgtctccccagcagacacaggccaactcctggaaatgcccacactggccggaccacccactcctgctcctctttttctcctaggagcagcttgtgcaagtactttgaggatagcaggaatatgaaaacactcaaggacccctgtaagtgtgtgatggggaagagtgggcaaggtaagggggtgtgatgggaacaatcacaggggccaaggaccaggatgtggtagccccccgccctgccccgcccaccctgccattccttgcttctcctctcctctacagacctgaagggggaactgctgaggcgcacaaaacgtgacattgtggactccctcagtgcgttgcccaaaactcagcatgacctcagctccatcctggtggacgtgtggtgccagacggtgagcacctgcttcctcccttgggcaggcccagagagccagaggtgggtaggaggttaaggaggatcctgagcacctgagcgcttccttttcaggaaaggatgctctgcttttctgtcaatggggttttcaaggaaggtgagtgtctgtatagtcccctccccagatcccccactgctccctccccctggctgggctccctctcagaactcccccagcttccctgctttcgttcctttcctttccttcctcttctttcttccgtgttttcccacccccactctgccttcaaaccaccctgatctgacctaggtccatgcctgtctgccctgcacagctcaggcgtgcgttaaggacacagactgtggagtttgacagctctcatcccaggtccttactctgtgaacttgtgctggttacttaacccttcagtttcctcatttgcaaaatggggctaataatctatctcttgggctactgtgaaataggaattaagtgaacttgtggttttcccagggccccacacatgataggggccctgtcactgggagcggattgttcctgttgctgccctccccattcctgccacatccgcctgactccaagtgaacaattgtcctggtctgccccctcccccccttctgtgtgagtgtcaagcaatactctgactggggatcaccgtgtgagcatgttaaagcctgtgcaactctaaggtggtggtgtttgttgtctttgaagtggaaggacagtctcagggttctgttctcgccttcacccggaccttcattgctacccctggcagcagttccaggttagtgctgtgttgtgggtgggagcacccatccaagcttggggccagtgttgtggaaatgtggtgggtgcagtcctccgggtgttctcaatattgtggaaggccgacaggaagatccaaggagcagtctagcctagtgtttaagagtgtgggccctggagtcagaatacagattctgttcctcactccaacactcacaaactgtgtgaccttgatcaacttattcgaccactctgtgattcagtgcctttttctgaaaattggaataagactatccacttccttgggctgttgtacagggtaaatgcgttggggttggatctaaaaatctagtgaagctggtagacagtccctccaaaggtggactctgtgggagggttagagggtaccagccaaaaaatctgggaggcaggcacagttagggatatggaaggaatttggttgttgagtggcagtggttaagaaggatcctgttgttgggggtgcggagttatctacttgtccagtttgagggtgcatttttctttcctccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgagtgctgggagtacatggggatgggggctgttgggacatcagaggaatgagtaatggaaactcacatgcaatttggaaaaataactatctgggtattttgcttccaaaaaaagtgggtccatgaaaaaggtatcatacttttatactggtatatgtaaatatttttttaaatggcataatgcccaaatgacattaccttccatttgtaaaatctgaaagaatcaaccacaataaactactgataaaccaggtcagcaaggttgaaagatacaatatacaaaaatcatttgtacttctatgtagttgcaatggacaatccaaaaaaatgaaattaagaaaataagtccatctacagtagcatcgaaaagaagaaagtatgtaggaacaaaattaagagaagaagcgcaaatcttgtactctgaaatctgcaaaacattgctgaaaaaaattaaagaagacctaaatacgtggaaaggcatcccacgttcatagattggaagacttaatatcattacgatggcagtaccacccagaacaatctacagattcattgcagtccctgacagaatcccaactgacttctttgcagaaattgacaaggtaatcccaaaattcatgtggaaatgcagtggaccccaaacagccaaaaccatcttgaaagagaagaacaacgttagaagactcacacttcccgatttcagaacttgctacaaaactacattaatcaagactgtatggtaccgacataggaacagacgtgggaatcaatggaatataattgagagtccacagataatctcacgtatttatgtccagttgattatcattcagggtgctgaaaaaatccaatggagaaaaaaaatagtcttcttaacaaatggtgctgggagaagtggatatccacttgcaaaacaattaattttgacccctaactcacatcacgtgcaaacactggcagaaaatggatcaatgacctaaaataagagccagaactgtaaaacactgtaagtgtacatcttcattaccttgaattaggcaaccatttcttacatatgaaaccaaaagcacaagcaaccaaagaaaaaataggtaaattggacttcatctaaattaaaagcttttgtgcatcagcagacactatcaagaaagcggaaaaccgactggtgggaacaagggaaaatatttgcaaatcacatcgccgacaagaagaacccttacaactcaacaacaaacagacaagccaccgaattaaaaaatggggaaatgatttgaatagatgtttctccaaaggagatatacaaatgaccaagaagcacgtgaaaatcttctcaacatcgttagtcattagggaaacgcatatcgaaaccacagtgagttaccacttcatacccactacgctagctttagtccataaaaggaaacatgacaaatgtcggtgagaatgcagagaaattggaaatctcatgtattactactgggaacataaagtggagcagttgctggcaaaaagattttggcagttcctcaaaatcttaaacatggagttaccacatgatccagtaatcccactcctaagtgtataccaaaagaaatgaaaatatatgcccattcaacaacttgcacatgaatttccgtagtggcattattccaaatagccaaaaaatggaaacacatggattgaccttcagctgatgaatggataatgtggtacatccatacggtggaatattattagaatattattcatccacaaaaaaggatgtagttgtgatatatgctatgacgtggatgaaccctgaaaacattatgtgctaagtgggagcacccagtcacaaaaagccacataattatatgattccattcatacgaagtgttcagaatagccagatccgtagagaccgaaagcagagtagtggttgccaagatctggggaagagggagaacagggagtgatctctaacagttaaggagtttctttttgaggtgataaaaacagtttggaattagataggtgtgatggttgcacaatcttgtgaatagacttaaaagcactgaattgtacaccttaaaatggtgactgctacagtatgtgcattatatctcaatagaaaagaaacgtattattgaatttccacttgttatttcttgaacatctttctttatcaatatgtattaagctcccttgttcatttgaataccgctatgtttctgatttgaattctagtgggcattaatgtcagggatgggcgttttggttttccccaggccttttttcattgttacaatagtgctcatattggtacatgtgacccagcaaaaaggtagcatagattaagggtggcattgcatagtcagcgtgtctgtcctgggctagtaatggagagcacctgttcttctcccaccccaggtgccttcaggacaatgagtggaactacactagagctggccaggccttcactatgctccaggtgaggtctgggaatcaagtgggtaaaagacagctgtctctgggtcgtcaggagggccaagaagatggaggccaggtagtgtggggatggaacccagtgcacctggctctactaacatcccaactccttttctttactttctctagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 4805 - DNA, 79461 bp, human
tgtggcaagattctgaggggaagtgtagctcccaggttggttccaagtcttcttccaattaggtaaattacaacaatatcttttccataaatttcctttcttttcttttttgcctttttttttttttttttttttttttgagacggagtttggctcttgttgcccaggctggggcgtaatgtcgcgatctcggctcaccacaacccccacctcccgggttcaagcgattctcctgcctcactcccaagtacctgggattacaggcatgcgccatcatgccaggctaatttttgtatttttagtagagagggggtttctccatattggttaggctggtctccaactcccgacctcaggggatccaccgcctcggccttccaaagtgctgggattacaggcgtgagcgtccgtgcccggcccttctataaattttatataaactaggccttttttggcctacattacctagggtcaaggtttagggattcataggaaaggcaaatccggctggattgctcagtggtccactctccagtccactctctatgtatcccttatcttcacgtgtgattaggttcaattgtatggctaatcacttcatgttctctctttgcaatttctcaggcaggttttctcttcttcttcagaaagttatatttctcttttgcatcttagttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagccactgattttgtcttttaaaattctttactctgaaataattttagacttacagaaaagttacaaaaatgattatacagagagccctcgcctggatttccttaatgttaacatcttatataaccatagaaaaattaccaaaactaactactacattacattgatgcactaattgacattactacatcgatgttaattaccaacagttagcattgatgtagtactattaactaatctacagattttatgtgaatttcaccagatatctcactgatgtcctttttctattctaggatcttatccaggacgcttcattgcatttggtcttcatttctccttagtctcctccaggctgacatttcctcaatctttattggtcttccacagccctgacacttttggagataccagtcaggtattttgtggaatgtctctcaatttgtgtttgtctcatgttttcttatgattagattgaagttgtgcatttgtagcaagcacacctgttttattctcctccctttcccagtggcgagggagggattcccaccctagtgttatgggggcggctgaacacatggtaccctatactggacagacggaatccacagcaatttatcagtaacatttactcacaactggagagaggagggcacctcacgccaggtagagccacacagtgtcacactctggaagagagtgaacaagcaggggctttcagggggaagtctttgtagtaaccagaggatgaagtgaccgttggttcagggtaggacgattggcttgtttgaataattctgcaggctggtggggacctgaaacatgctacccagagataagcaggcactgtgtctgttcaacatgataataaggagggtactttggccagggggcctttctccctgggaacccaatagggaagataacttgtggtgaggccattcagggtcctcctgttctaccccagatgtcaaggcatccatataattggacctctaattttaggtcttatgcgacattaccgcaaacgtgatttcgttcccttctatgtggatcatgtcaggggtacatgacatccataagttgtattactggtggtgctcaccttgatcacttggttaaagtggtgggagttatgctgccccagtgtaatgctactattttcctctttgttagtaataaatatagtgtgaaaagttctttaagaagaaacacaatagatcctcttatattcctgtttcttcgcagactttgacccactactgttaaaatctgtctagggatcttgcctacagcaaatattacctaatggtgattttctgttttcctaatttctgctacatttattaattggaattcctctgtaaggaagagctatctttactccctcattcatttatttcttcaatttatttatctcagtatgggctcttgaataattatgttatacatgccaggcttaatacctaggtgatgggttgatgggtgcagcaaaccaccagggcgcaggtttacctatgtaatgaacctgcacatcctgcgcatgtatcctggaacttgcaataaaataaaataaaaatttaatctaattatatcattattttgttctttgaactgttctagccttggccattgggaagtcattttggttggttctgtggtcttttgatatgaccctatccttttttggtacctttttctggcacaataagatgttcagattcagcatgtgtgtgcccccctcccctcacacacacacaccccttatagccctggattaaaacaacttctacgaggagccccggttccctttcttggggaatgatatttaccaaccagtatctcggtgtgtgttcattattaatggcgtttcattgctgctaaggctctctctatggagagggttaggaaataatgtatgtatacacccatgcctatagacacatccacatttattttggtatctatctgtatgcatagctattaaaagccaggagcttgtattgatactttcaattccaatcattctagacttatttgtagattcgttctccgacctggctttcattatcaaatagtttacatacctgtttatttctggtcagtagatacataaagtagcgcctgaattgctaacaaatgcccctgttgcaaacatattaataacttatatttttgtacagttgtttttgtctttggccttagaggatatagtcaaaatactgctctccaaagttatgtatcttagatcttttcttcctctctccttcagcgtggttaagacactcatttgtaatattgttagttgaacctgtttctgtttgatttggggtaccctcaccccaatatcccggttgattttaattttttatttatattttgggtatgtgcatcattactatgatccaaagagtcagggttatacaaaaacctatactcggagaaatgtcactccttcgtcatcccttctaccctgttcccattccccatttctttccacttctttccctggccctccctgtagggtaatcagcccctttggtttctggtttaacctttcctgtatttattttgcccaaatgagcagatacatacatgttttctcatattcctttcttacacgaaggatagcatactatacatgttcctttgcactttgcctttcctacttaacagcattcttggaaatcactccatattgtttcacagagatcttcatcgttcgtttttacagctgcattgtactccattgtgtggctgcgccacacatagtttattcaaccactcgcctatgtttgggcattttgtttttaatacagaaaccaggtctcgctctataacccaggctgactgaagtgcagtggcacaatcatagctcatggtaacctcaaactcctgggctcaagcaattcacaactgcctcagcctcccaagtggctaggactacaggtgtgtgccaccatgcctggctaattaaagactttttattttttattttattttttgtcgatatggggcctcgctatgttgcccagactggtctggatctcctggcctccagtgatcctcccgccttggtctccaaagtgctgagattacaggcatgagccatggtgcctggcctgtatgggcttttaaattccttccaagattttgcagttacagacattactcccgcgaataaccctggacatgattttttttttttttttgtattggtagaaatgtaccttcaaggtatattcccactggtaggattattgggccaaaagttaagtgcacatgtagttttcttaggtgtttccaagtttctctccagaaggattgtactggttttcatttccattagcaatatatgagaatgacaatttccccacagcctcactaacagaacatgttgccttacttttgaaacttttttctacgggttaggcgagaaatggtgtctcgctgtttctgtaatatacctttgtctaactatgagcaagttttgacacttaaccatatatttgaggactgtttttatactttttgttggaattatctgttcatatctttcccccatatttctattgctgttgtggtccttcatccctcaatatttaagagctctctatatatttggaatattatccagttgtctgcgatatgtgctgcaagtactttacatcaatttgtcagttgccttttgatttatttatgatgcatttgcatcactttcgtttatccttatgtggtcaaatggattgattatttttttctttcattgcctccggaatttgaatcctagttagaaagcttttccctacagtggggttctgccatgttttgttttgttttgttttgttttttctttcttttctttggttgacatggagtctcgctttgtcgtccaggctggagtgcagtggcgcgatctcggctcactgcaacctctgcctcccaggttcaagcaattctcctgtctcagcctctcgagtagctgggattacagccgcccgccacctcgcctggctcattttcgtatttttagtagagacggggtttcaccattttggccaggctggtctcaaactccggacctcaggcgatccacccgcttcagcctcccaaagtgctgggattataggcgtgagccacccccctcccccggccactgccatgttttcttcaagaacttacatggtttcatttgttatgtttagatccctaacccatttgcagtttattcttgtgcatgctgtgttatatggatctacctttatttttccagacgtctcagttgttccaggaccatttattaaatgtccatctttgccctaaagagtttatgtgccatctttatcatgtactaactgtcatatgatttggttgtatttctgagttttctattctagtccactgggctattagtctattcttgcaccagtgccacaatgtcgtaattacagaggctttatagtgtgcttttctggctgatatcataagtcccctctcatagattttctttttcacgtgtttcctggctatgcttgcatgttttcacaaatatattaactttattatcaatttgcctaaatgcataaaaatgtgtgctggcgtttttgcgactgaattaaatttatacaccaatttaggaagaaccgacatctttttaatgctggattattccatctaggacagtgacgtagtctgtttgggctgctattacaaaataccatagactaggtagtttataaacaacagaaatttatttctcgcagctctggagactgacaagtccaagataaagattctggctgatttggtgtctggtgaggaccctcttcctcatcgatggtactttctaattgtatcctcaacatggtggaagggacaaggcagctctctgaagcctcttttatgagagaactaatcccattcataagggctccacccttatgacctagtcgcctctcaaaaggccccacctcctaatggcatcaccttgcgggtaaaatttcctaacctgcacattgtgcacatgtaccctaaaacttgaagtgtaataataataaaataaaataaaataaaaataaaaataaaaaatttcaagatagtaattttgggggtacacaaacattcagaccatctcagatagcgtatgtgtttccatttgttcaagtcttctgtggtgtcattcaggcatatttaaaaatttttcttgtataaatgttgttatcaagtttattcctaaactttaatccttgttgctagtgtatatggggctttgtctgtgaatgtatcctccagctgcttattttttgtgtgtgtattaaaagactgctgattttttgtatgttaattttatattttgctaccttaatgacttcttttactggttcagttgatttatcatcgtttctatagggtttttcaggtatactataatatcatctgcatgtagagatggctttacttctctttgtaaaaagtaagttttattgtgtatatctaaggtatacaacacggtgttatgggacacgtatggatagtaaaatagttactatagtggaacaaattaacataacccattatgtcacatagtgacccatttttggttttggtagcagtaggcgctaaaatctattcatttagcagaaatcccgcatcatacttaatagtacaattgtacaaactgtattccagcatgttgtgcactagatctctagtctctttcatcctacatatctgctactttgcatcctctgacctacatctcccgctttcctcctcccatcccctcctccccaccccgaccctgataaccactgctttattctgtatctctgtatatttgagttttgttttacttttatttttttaagattccacatataagtgagatcatgcaatatttctctttctgtatctggattatttcactattatttcattgttatagcataatgtcctccagattcatccatgttttggcaaatggcaagatctcctttttaaagtgtatacatacaacacattttctgtatccatctgtcccttgatggacacctaggttgtttccatatcttggctattgtgattaatgctgcagtgaacatgggagttcagatacttttcaaagatcagctactttcaaaaggtggttattttatttcctttaagtagatacccagaaaagcagttgctgggtcatatgatagttctctttttcactaccatatttttttctaaaatagaaaaatgtagaactaccattttatttactaaaacagaaaaaaaaaatctatttctttaggtacctccatactgttttccataatgattgtccctatctacattcccatcaacagtgtacaagggttcccttttctccacacactcggcaatgtttgccatctcttggctttttgataatagctatcctaatggttgtatggtgttgcctcatagtagcttttatctgcattttcctgatgattaatgatgttgagcactttttcatacacctgttagtcagtgtgtatgtcttctttggagaaatgtctattcaggtcctttgcccgttgtttaaatttgattgtttttctgctatggagttgtatgatttccttacaaaatttggatgctaaccccttattcatatatatgttttgcaagtatttgctctcaatgtgtaagttgccatttcattttgttgattgttccctttgctgtgctttttagttcttcttattcattcctaggaaaatgatctatttctctgctcagttgactaatacttgtaatgcaagattgaataggtgtgaggtagtaggcatgctttccttgttcctgatcccaagggaaagcttcgagtgcccccccaccccattaaataagttactagcattaggacttaggtatatatgttttatcatgttaagaaagcatcctgtggtgcctattttcttaaggcttttctattttttaacataaagaggtgttgaatttttccaaaggctttttcaacatctgtggtgataaccatatgatatttgtctttaagtatattaatatggtggatgatatcaaggtactttctaatattgagccaatctgtattgatgggataaatcccactttgccaaagtatattatgattttttaaatatgttgtttgctaatattttatctagcatttttgcatctacacttatctatccatgtcacacttgcttcataaaggaagttatgaaaatttcctttataatgctgttgaataatttatagagcattggcactctggtactatctgatctttgaaggtttagtagaattgacctgtaatagcatctgagccaggtgcttcttgggagttattccttaataactttttccatttttttctgtaaaaattggccaagttaagccttccagcattagagtaaaaatcttgataatctgtattttcctaggaaattatttatttcatgtgtatttttaatttctttatacacaggtttgaaaagcaacctaattttttctgtttaaatgattatcatttgtcgtttattattttgtatatttgtgctctctccctttcttccttcattaatctgcctagtgagtttgtccattaaaaaaaaaaccaggattttgatttaataaatatacacacattgtttttctactatgtatcttattaacatctgcttatgtattcattcattcattcattcattcattcattttaatgaccgaatctccctggatcactcagtctggagtgcagcgttgtgatcacagctcactgcagccttgagctcctgggctcaagcaatcttcccacctccgcctcctcagtaagtaggactacaggcatgttccatcacgccctgctaaagaatcattattattattattattactgtagaggcagggtctccttatgttgcccaggctggtctcaaacgcctggcctcaagtgatcctcccgcctcagcctctcaaagtggttggattacaggtgtgagccaccaagcccggcaatttctgcttttatgttatttctttatttgtgtttcttttggtttcccgggttgttcttttattagatttttgaggcagtgctttaatttgtctaattttattcgttcattttcattgatgagagtatttagcgctctgaatctgcttccaatcactgctttaactatcttctacagagtctcatatgtaagctcttataatcactcttcttaaatatttctgtaacttcagttggtatctcgtctttatctcgacatttgcttaatagaagactgaacattttttccaggtagaagagcctttgtgctttcagtttgtgttagtaagttctacttttgttgcatcgtgattgcagagggttggttgtaatatttctactttatggaaattagcgaggccttcactgtgaggtaattatgatcacgttttgttaacgtgccatcagcttttgacaaggtggtatattctttatctccaaggtgtagatttatgtgtgtgtatgtatgcctatgtgtgtatacacacacacaatgtatcttattgtgttgtttacattttcggtataggtctctttattgtaccactggatttgccttgtactgagacttgccatgtattaaatctcctattattactgtgcttcaatgtctccataccttttggcattacaaaggtggttcctatgttatttggtgcataagtattcctaagtattatatattcactgtgaattttcaattttaatgttagcatgtaaactttgtcattaaaaaaattacttttagcacctgctttcttattgaacattttactatctggtccactagtttgtttttaacccccagtctccttttaacactcatctactgccttatgaaaaaaaaaaagtttattctctttttctttctatctctctcacttctcttattttacttgcactatttctttttttccacaatataaaataaatgcacgttagtcattttccttgcttcaccttcattttagtattagataccaaatgcttgccatcagatgttgtagggaagattttcctgtcgttacctgtggaatcacaatcccagtttaccctttagaatataagttagcaaacgttttctgtaaagagccatatggtaaatattccaaccagtgggccatagtttgcagacccttgctctagtggagtcctcaggaagggctgatgggtacataatttcctaagttcctgtctgtttttctataagctgtgatattagtgaaggatcggctgagctggatatcaaatcagtacttcagacgtttttctcagcccatttctgagtttagagttttaagtaatattctaattcaaggcaggttttatatcctcaaatgcttgtttgaatggaattaattctgtttgcagggttgacgtacagttccttctgtttcatggttgtttaatatgtgtgaaatttgtcttctgctctttttctctttctggaatgtttttgtaaggaattatccttccttttgttcatttttatgatattggattgttttaccagattcctattttacaggtgctattttctgtcagtgtagaaaaattcaggcctgaaatttactgatttcgtttgcttgttttggtagcggacaaagaagttatgagtgctctgattctgtggttctcttatgtcttgcaagattcttcattttccccttttgtttcttttccccatcattaccaaagtggcaaagcatgcttctccctttctgtttgcccttactcttacccagaagctgtggatttcaaaggctacttttattttattttattttaatttgagatagagtctcgctctgtctcccaggctggagtgcaggggtgtgatctcggctcactgcaacttctgcctcctgggctccagcgatcctcccacctcagcctcccgagtagctgggaccacaggcgcacaccaccacacttggccactgttttaagttttcgtagagacgaggtctcactatattgcctaggctggtctgaaactcctgggctcagtggtcctcctgcctcgggcctcccaaagtgatgggattacaggcatgagccactgcacccaacccaaagactacattctaagatcatctctacccctttaaattacacgtattttagaggtccttccctgtagtccctgctcttattatctgggacacctttttggtatttttttagacttagtctgggctcagtcattttaactgtagtttcggaccaactttaagtcccttgcctcttcctttctctgtgtctcttgcagcttttcttggtctgtctttgcttgccacaaagactagtgatgagagcatgacagatcttgtgctgggatttcatgccttttctccttttactcactactaaagatttggcattatctgtttctaagtaacgatgaggatgtggcttctgtatagatttacatcttcctttctgattggtttatatccttttgacatgaaacattgggaggcaggtgcctgggtggtcgacattgccttatgctgacttacagctgatttcaaatggcattttatcttatctaaatacatatgtgtgtgtatacacacacagacagacagacaccacacacacacacacacacacacacacacacacacacaccaacacagacatttatacacacatacaagtctatttgtattccatgtctatagtagaggtctcttgaagtggtcgtttgatttaccatatatttgttcaatacatatttcatttattgctatctttggtggcaggcaagagactgtgaaaatcttctcaggatttgttaatgttcctcaccctaaagcaggttcatgtcaatggaccaaaaggtgccagccacactgctagagctcgctgcatggagtctgctgagtgatgagcctgcagctatccatgctcttgaggagctcccatgagacctctttgttccattgttcatcactgccttcttgggtgggcagaagatgaaactaaaggccatggtgaggatttggccctcccgttgtctccatgttggaccgttgagtgtaagggagtcacactatgaaatcttgggagccacgattgatggtcctgcagatcctccctgcccagagctcttcccctcggtaaccctatgtacactagagacatagtgagtcatcaggagggtatgctgcagcctgaggcagggggtggcctaacagtctcccaaaggtggttgacggtgaatgctgaggatctctgtgaggttgttggtccaacacttggggtcaccttaaggactctaatgtcttacagaggtgattatggaatagaggtgattgagagtactattgatggattcacctactgggtatgattacatagaagaacaacatggacaccagactggggaggatcggaggagaaggaaggatgggaaaaacaataaaagatgttgagtttgtacaaaaaaatatttgttggtagattgtttacagagtgaagagcaaagataaagggtttgcccctccttcccctcattgatgttgctgggttatattaaaatcagccacctttcatattctgtctcttcctcttcctgcagacggccaaaacggagggtcctggatttaaagcaggacccagacagcagaaccacatgctctgagatcaggagcacattcccattttgttttcagtcttgcgtttactctcagcactctatcctgaaaatagaagaagccaagcgaagtgttaggtgcctggaaattgtacatttagagtctgagtctcggcccatccagggaacgcatgggattgttagtggacatttcccttgatggtaccttgagaacaaggcaactcttttctttcctttcgagtaaagttgagcagagccttgggtccttgcatctctgctgcagagatttgcaaattcatcaagtgtctgcccacaaaagcgtcctgtagtttctggatctgggatgcactgatcacctggaagtaggtcaggcttgtttgagtgaagtcagcacccttttggcacagaagatccaccaggacagacttagtctatctaaaatccttttaaaatcctgtaaggggagaaacttctcaacttttttcactcatcatgagcagatgaacaacctccaggaactcagcttgtcttgcttctgcctcacagatcagctggacaaaatttccgggtgagaggttggggagggacctgggttccctgaatgccccattacgaacaaaagagtgcgactattcttagatattcttaaacactttgtaacctatttctccttccacatcagcacgggcactgctgggtgttttaaactggccaagctagagagtgtggtccctcatgctgaggagaaagacaggattagaaaagtcagctgtgcccagtcagtcagtcagtcagtcagtcaatcaaccatgtgcagacgtgcagacactaagataagtctgtcgacatattggcgaaaaagacaacagtcctgcttttattggagtgtgtagccttctagagaggaaggggaggcattcagtcggagaaataactgacgctgtagcactgatgcacatccccatgggctggtcacaataggtaataccgccagatcgttttgttcctgtagttttcccgaggcttaggacctgaatggagaacctgtcatttggaaattcgtcaaagggaattctcagtcggctgctttcccagacccatccccatcaaataactgaactagatacactgctaattatactgtaggcactaagttaaattctttttcccttaatctgtcccacaaccctctataataattgctattgtgcacatttgaaagattaaaaaactgtatctcagcgtggaaaagtaactttcttagggtcacaaatctattaagtctgactgtaaagtccacagtgttaactgctgttgcaatggatatacagattactttattctagagtcataagtatctataattcagggctgcttgctctaatccaaccctcattcttcagaaatgccttccttttttctctctacagagccctgccatctcatttgtacacactgtatgtgtctttctgtggactttctaccagagagacatcactgtcctatcccagagctctgaggttacccacctaagactgttgagtctgagtaacaatcagatatcctgggaagtttctgagccattccaggctctgctggagacggtctcagggaccctgcagcatctggagatagacaactgcctgataactgattctactttctctgttgtcatcccagccctgagccactgttcccacctctgtgtccctagctttgtcttcaaccccattacaatgcctgtgctcacgagtcttctgcagcacttaacagcgttgatggagctgaagcatgtgatttatcctgtccctgtccattgctatgaacaatggcaatcacatggcagtttggacatacaagcttgctaaagtgcaggcctcattgaaggtgatgctgcaggcagtaccacagaacgacatgaactagaccacccattctcagtgatcttcacaggacaaggagttgtttcatcactgatgtgtggccactaaaatactgagtgttcttgcctgaagcccaatttgtaaagacacataatgtgccattctgctattccaggaaactggtgttaggaagattggatatgtaactgacctccataaaagaaaaactctaagaaggaaacagcagactttacgaagtcttgtgggtctcttgcccattgtcctctacgtcctccttcttgttactgaccacagtgttgggtacgtgacatgggctgacccagtcgtggcacaccatttccctgtccacactgatcggttcacttatgggtacttgacgcaagtcaggacagttgaaacctttcctggatgtttttctggagtaggtgctggttactgaagccaataatattactcactgaggtcctttaatcttcctgtattcatgattgccttaggttgcttatgacaaaccattggcaattaaaatgaaaaacaagaacaacaagaaacaaactatccccactacctactggtgtctttatcagtatattgctatctcctttcctaggtctcagaagcctggggttcagtttgcccttatttcacacagattcaccaaagatctgttattagctaggtactgttcctggtgctaagaatgaataggcaaacaagaccctacaccaagtcactcacagtacagatcttcctatgttttgtctgtttccccgctcttttcttaggggatttgggaaagttattttgcccatctatggcccagaatttttttttttttttttttttttttttttttttttttttttgctttgccccttgcatactctgctcaatccacattggcctctttatgctgttggatagctcatcaagactcaggccgtagcttagatgttacgtcctccgagaggtttttctcttacttccctctccttacttaccccacttctctcccattacttcccttacttcaccatgctgtttttaaatgtaccatgtacatttccttcatggtacacatcattccatatgtatttgctccctctgctcctcccctagagttgcactattcagtatagtaaacactagccacatgtggctactgagcactagaaatttggctactccaaaatgtgatgtacgataactgtaaaacgcacacggtatattcaagacttagtgagaaacaaaaaatgtagaataactaactaataacttatttgtattgtttacgtgttgaaatgataagttactgcaggtcaaagacagtaaaaaaagaagacagagtactaatgtgtttatattgttcaacatgttgaaatgatagcactgcggcaaagacaatcactctcagcattcctattgaatacctccttggaagacccaaccggtacaataaagcaaaggaaagcactaaaaggcacacagattggaaatgaagtcatgaaaaagtgtccctatttactgacatggtggctatgtataaaatttctgggaatttatgaaaaacctcctagaactaatgagtgagtgtgcctaggttgccgtataccaggtcaatattaaaagtaggtcaactctatttttatatacagtcctccctttgcacagttctgatatgcactaaggtcattcaccgtgatttagttaaataacactagtcccttcacagtatgggtcaaatttcagttaccatggtaaactaactgtcagtaactacataaagaccaaacattgctgctggttcttcagtccacaaatcgctactgaaataacagatgagaatcatgatcagtggccagtcatgtcacttctttcaaattctgtttgtgtcgctccacaaatcactatttaaataatagatgagcatcaggatcagtgaccagtcatgtcacttttcttttaaaatctaatcatgtttggtcactgagtatctattatttatttcatgcatcaacagcaaagaatgaagctgagtttcctccttgtctcccagtgaactactcatatgacattttaccaaagaactggatagtttaaaaaggtaattggccaacaaagacagaaacatgcaaacaaatgacaagaaataatgctggaagtggaaattgcaaaacggttttgatggaaaggattaagatatcccagtgaaagtgacacttgcaaaaaactttacactacaggattccttggagatattcatgacacagaaagaacaaagaataaagttgtggaagctgatcaacactcaaaactgagaaacaaaatttgccaagtcacgggaaaaaatgtctactccatatcacaattaataagatgagaagaaggcaagaactgttcatactactctttttttttccatgagaaattctggatttaattttatttggaatgtcaccaacttctctggcataacatatggtataattatttttagaatgtgattactttatgaatatttgaagacatttttatgttttgagcacttttctgaaacaatagcttctgttttagtgcatagtagtggacaaggccagaattgatgtttttctgtaacattaagctagtaatggtagaagcagttagataaattcaagtcccttgactccagtcacaagacttcctctaaattattgtgactttgtaaaatattcttaatttgaattttttttttattaatccaatagttatttacattgatcttaagtaaaatttgtatgtggcggccaggcacggtggctcacgcctgtaatcccagcactttggaaagctgaggcaggcggatcacttgagatcaggagttcgagaccagcctggctaacatggtgaaaccctgtctctactaaaaaaaaaaaaaaacaaaaaacaaattagtcagttgtggtggcgggcgcctatagtcccagctactcaggaggctgcggcaggacaattgcttgaaacccggtaggcggaggttgcagtgagccgagatcatgccattgcaccccagcctgggcaacagagtgagactctttgtctcaaaaaaaaaaattgtatgtggctacttattgttaatttcactttcattgacatttctactttcacttcacagtgctttaaaaataggcaggccaacattcagattcaggaaatacagagaacaccacaaagatactcctcgagaagagcaactccaggacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgggggccaatattcaacattcttaaggaaaagaattttcaacccagaatgtcatatccagccaaactaagcttcataagtgaaggagaaataaaatactttacagacaagcaaatgctgagggattttgtcaccaccaggcctgccctaacagagcttctgaaggaagcactaaacatggaaaggaacaaccggtaccagccactgcaaaaacatgccaaagtgtaaagaccatcgaggctaggaagaaactgcatcaactaacgagcaaaataaccagctaacatcataatgacaggatcggattcacacattacaatattaaccttaaatgtaaatgggctaaaggctccaattaaaaggcacagactggcaaattgggtaaagagtcaagacccatcagtgtgctgtattcaggaaacccgtctcacgtgcagagacacacataggctcaaaataaagggatggaggaagatctaccaagcaaacggaaaacaaaaaaaggcaggggttgcaatcctagtctctgataaaacagactttaaaccaacaaagatcaaaagagacaaagaaggcccttacataatggtaaagggatcaattcaacaagaagagctaactatcctaaatatatatgcacccaatgcaggagcacccagattcataaagcaagtccttagagacctacaaagagacttagactcccacagaataataatgggagactttaacaccccactgtcaacattggacagatcaatgagacagaaagttcacaaggatatccaggaattgaactcagctctgcaccaagtggacctaatagacatgtatagaactctccacccgaaatcaacagaatatacattcttttcagcaccacaccacacctattccaaaattgaccacatagttggaagtaaagcactcctcagcaaatgtaaaagaacagaaattctaacaaactgtctctcagaccacagtgcaatcaaactagaactcaggattaagaaactcactcaaaaccgctcaactacatggaaactgaacaacctgctcctgaatgactactgggtacataaggaaatgaaggcagaaataaagatgttctttgaaaccaacgagaacaaagacacaacataccagaatctctgggacacattcaaagcagtgcgtagagggaaatttatagcactaaatgcccacaagagaaagcaggaaagatctaaaattgacaccctaacatcacaattaagagaactagagaagcaagagcaatcacattcaaaagctagcagaaggcaagaaataactaagatcagagcagaactgaaggggatagagacacaaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatatcactactgatcccacagaaatacaaactaccatcagagaatactataaacacctctatgcaaataaacttgtaaatctagaagaaatggataaattcctcgacacatacactcgcccaagactaaacctgggaagaagttgaatatctgaatagaccaataacaggctctgaaagtgaggcaataattaatagcttaccaaacaaaaaaagtccaggaccagatggattcacgcccccgaattctaccagaggtagaaggaggagctggtaccattccttctgaaactattccaagcaatagaaaaagagggaatcctccctaactcattttatgaggacagcatcatcctgataccaaagcctggcagagacacagcaaaaaaagagaattctagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatacacaaatcaataaacgtaatccagcatataaacagaaccaaagacaaaaaccatatgatcatctcaatagatgcagaaaaggcctttgacaaaattcagcaacccttcaagctaaaaactctccataaattaggtattgatgggacgtatttcaaaataataagagctatctatgacaaacccacagccaatatcatactgaatgggcaaaaactagaagcattccctttgaaaactggcacaagacagggatgccctctctcaccactcctattcaacatagtgttggaagttctggccagggcaatcaggcaggagaaggaaataacgtgtattcagttaggaaaagaggaagtcaaattgtccctgtttgcagatgacatgattgtatatctagaaaaccccatcgtctcagccccagatctccttaagctgataagcaactgcagcaaagtgtcaggatacaaaatcaatgtgcaaaaatcacaagcattcctataccccaataacagacaaacggagagccaaatcatgagtgaactcccactcacagttgcttcaaagagaataaaatacctaggaatccaatttacaaggaacgtgaaggacctcttcaaggagaactacaaaccactgctcaatgaaataaaagaggatacaaacaaatggaagaacattccatgctcatgggtaggaagaatcaatatcgtgaaaatgaccatactgcccaaggtaatttatagattcaatgccatccccatcaagctaccaatgattttcttcacagaattggaaaaaactactgtaaagttcatatggaaccaaaaaagagcccgcattgccaagtcaatcctaagccaaaagaacaaagctggaggcatcactctacctgacttcaaactatactacaaggctacagtaaccaaaacagcatggtaccggtaccaaaacagagatatagaccaacggaacagaacagagccctcagatataatgccacatatctacaactatctgatctttgacaaacctgagaaaaacaagaaatggggaaaggattccctattttggaaatggtgctgggaaaactggctagccgtatgtagaaagctgaaactggatcccttccttacaccttatacaaaaattaattcaagatggattgaagacttaaatgttagacctaaaaccatagaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccgtcagagtgaacaggcaacctacagaatgggaggaaaattttgcaatctactcatctgacaaagggctaatatccagaatctacaacgaactccaacaaatttacaagaaaaaaacaaaccaccccctcaacaagtaggcgaaggatatgaacagacacttctcaaaagaagacatttatgcagccaaaagacacatgaaaaaatgctcatcatcactggccatcagagaaatgcaaatcaaaaccacagtgaggtaccatctcacaccagttagaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgatgtaaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtagggacatggatgaagctggaaaccatcattctcagcaaactagcgcaaggacaaaaaaccaaacaccgcatgttctcactcttaggtggggattgaacaatgagaacacatggacacaggaaggggaacatcacacaccggggcctgttgtgtggtggggggcacgggggagggatagcattaggagatatacctaatgttaaatgacgagttaatgggtgcaggacaccaacatggcacatgtatacatatgtaacacacctgcacgttgtgcacatgcaccctaaaacttaaagtataataaaaaaaaaaatgacctgttggatttctactttgatgaagttaatgtcatttttaggcctaaaactttttcttttttaaaaaaatcttcaggtgtttttaaattttatttcattttgttttaagttccaggatacatgtgcatgacgtgcaggtttgttatatagacaaacgtgtgtcgtggtttgctgcacctatcagcccatcacctaggaattaagccccgcatgcattagctatttattctgatgttctccctcccccggtgcccccgaccaggccccactgtgtgttgttcccctccctgtgtccatgtgttctcgatgttcagctaccccttttaagtgagaacatgtggtgtttggttttctgttcctgcattagtttgctgaggataatggtttccagctccatccatgtccctgcaaaggaaatgatcttgttcctttttgtggctacatagtattccgtggtgtatatgtaccgcattttctgtatccattctattattgaaggccatttgggttgattcattgcctttggtattgtgaatagggcagcaatgaacatatgcatgcatatatatttataatggtatgatttatattcctttgggtatatacccagtaatgggattgttggttcaaatgatatttctgtttctaggtctttgaggaatcaccacactgtcttccacaatggtggagctgacttacactcccaccaacagtttaaaagcaatcctatttctccacagcctcgccagcatcttttgtttcgtgactttataaaaaccgccattctgactggtgtgagatagtacctcacagtggttttgacttttatttgtctaatgatcagtgatgttgagcttttttttatatgtttgttggccgcataaatatcttcttttgaaaagtgtttgttcatgttctttgcccactttttaatggggttgtttgttttttcttgtaaatttgtttaagttccttgtagattctggatattagacctttgtcagatggatagactgcaaaaatttccacccactctgtaggttgtctgttcactctgatgatagtttcttttgctctgcagaagctctttagtttcattagatcccctttgtcaatttttgcttttgttgcaattgcttttgatgtttttgtcatgaagtctttgcccgtgcctgtgtcctgaatggtattgcctagattttcttctaggatttttatagttttgggttttacatttaagtgtttaatccgtcttgagttaattttggtataaagtgtaaggaaggggtctggtttcagtttactacaggggtctggtttcagtttactacatatggctagccagttctccaagcaccatttattaaatagggaatccttaccacattgcttctttctgttaggtttgtcaagggtcagatggctgtagatgtgcagtcttatttatgagatctctattctgttccattggtctatatgtctgtttttgtaccggtaccttgctgtttcactgtcaagtgctggaaaaagaacaaaaggaactgtctctcattgtcgatggaagtataaaatggccaagacactttgaaaaacaatttggcaggtttgcatgaagttaaaggtacacttatacagcaatcgcactccagggtatttacccaagagaagtgaaatccttcttcccaggaaaccttccagcaaaacgttcttaattgctaaaaactggaaacatctcaaatgcccatcaactggggaatggataaacaaattgtggtatgtacctacactggaagactactcgacaacaagacagttctaagtactgataacataatatgcgtgccacagaatggatgactctcaaaatacattatgctaagtgaaagaagacatactcaaaagactacatacaatgccatttctttggctttatagaaaagggaaaactagagagagaacaaatcaatcagtggttctcttgggctatagaagatcaactttaaaagggcatgagggcactttatggaggtttggacatgtcctagatcttcattcttgggttgatcacatggttgcatgcttttgtcaaaatgcacagaatggtggactgaaaaggggagaatgttatactatgtctcaaaactcggcaccttgattgttattttgtaacctgcctttctccccactgtgtcctgaatcagcaaaaactctatcggttctagggcgtgattcctgctgtaatccccaactctgacagactgtcatccctgtattcctgattctgacctggtttgcctctgatttggaagatatgctttctcagatcctctgccactcttactcattaaccttactcagagcctcctgaaactcactcagtgcaatacaaaggagggatccacagctgcacagaaggtggttgtcagtttctggcttttccatgattcttctgagatgtgttgactaggagtccctgggcttcatccatagattcattctttcaccaaatatgtgttgaacattttccatatgcggtggattctgtcatcatttcctgtttattctccactgcctaacccagaaccagatgttcacgatgtccagttaacaaacgcttctggagcacatatgatgctctaagccctgtgcctggcaccagaaagacagataaattggaaaagaccatctttgtcatctctagcgtcacatgccctccgtggtggacataaagatctattaagcatgtcttttattttctgtgtcgtgatgctttgacatcctgggccttgctgaccctggaaggcttgctcctcccaggcctggtaaggcaattcttagaaatagtaaacaccttgccctggagcgtgcttttcaaatgcaaacaaatcaacggggatacaatacctcccaaccatgtcctatatagggctctcacaccctgggtcactatccacctgccctaatcaccccaaggccaggtaccaggcaactagggacagcccctatgccccaaggctgcttaaattattcagactagccaatcctaaactggttactctcccttgcctgttccttcccacagaggcagagacaacaacaaatgctctggcttgcagttctcctgtctccctctggcccggaccaaccatggtgcttcgccatgagatttcccatgtctgggcatcctttcttctcttcggaactgtgactaacaatctgtctctccaaggcagtcatttcctgatctgtttcaaatgttctactaatccactctattttaaaacactctcagattcccctttaggatgttttcctcgctctgctgggagtgctgtccacagacagccttcagctaccagcttccttggagagcaccttggctccggagagcctccttgtttttccagtggcccacattcagtgactggtggaggcaggagtataaaatcagacatttttaatcaacgtaagaaaaccccaagggtcatttttagcttcagagtaccccatggagctggctgagggtaatgagacctcatagtagctcatttccttccttttccaaattctgtgttctgactgtgctctccacaggtactcatcccatatgtactctcacataaacatcctgcacaataaaatcagtcacacagactatctgttgcagtgcttcaagcatttgaaaaatatggtggagattgtaatggataaataagattctatggctactactaagctcaactgacactctagaagaagacaaagaaatcagagagaaattattatgcacttgaaagccgactgcgaaagccacagggcttccttgggattatacggagactttcaactcctggcacaggatggcagagaaagcttgtgatttaataatcatagaagtaaacctccaaagaaggttaaatttccacccaaagtaggaccgtttctccaggttcatggctcgcactgggcaaaattgagacccataatgtagtttggaatgagacctctagaaacctgaatttccacaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaagaaatcaagactgatgacaggtatactgaagagtttcgcagcccttccaacccctgccacaggaaactcgggatcctttgttcaattcctggacctgaatcaattttttacatctggaactttttgactgaaaaggaggttgggtacccaggcagagaaggtctgtgcagcaccacagcctgtggacacagtaatgattcacccagacctcccctcaagaggcatccatccgttgattcacgtcaccatgaactgtggaaaggaaaatgcccaggtatcttgagaaatgtcaagcatggagtaggagatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcttcctcttcctcttcctcttcttccttcttcttcttcttcttcttcttcttcttcttcttcttcttcttcttcttcttcttctttcttcttctatcccttcaagcatttattctttgagttgcaaacaatacaattgcattccttaagttattttaaaatatacggttaagttattattgactatagtcactgtgttgtgctatcaagtaataggtcttattcattgtttctggttaaccattaaccatctccaccacttccccaactccccactaccaatcccagcctctggaagccatccttctactttctgtgtccatgagttcaactgatttgatttttagatcccacaaataagtgagaacatcagatgtttgtctttctgtgcctggcttatttgccttgacatgacgatctccagttccctccatgctgttggaaatgacaggatctcattcttcttcatggctgaagagtactccattgggtatgtgcaccacattttctttatccattcatctgtcgatggacacttgggttgcttccagatcttagctgttgtaaacagttctgcagcaaacataggagtgtagatatatctttgacatactgatttcctttcctttgggtatatactcagcaatgggattgctggatcatatggtagctcaatttttagtttttggaggaacctccacacggttctccaaatggttgtactaatttacattcctaccaaaagtgtgggaactttcccttttctccacatccatgccagcatttgttactccctgtcttttggatataagccatcttaactggggtgagatgatatcgaatttttgacttgtgtttctcggatgatcaatgatgttgaacaccatttcatatgcctgtttgccatttgtgtgtcttcttttgagaaacgtccattcaaatcttttgcccatctttcgatcagattattagattttttcctatagagttgtttgaaatccttgtatatgctagttattaatctcttgtcagaggagtggtttgaaaatattttctcccattctgtgggttgtcacttcactttgttgattgtatcctttgctgtgaagaagctttttaacttgacgtgatcccgtttgtccatgtttgctttggtcgtctgtgcttgtggggtgttgctcaagaagtctttgcccagacctatgtcctggagatttttcccaatgttttcttgtagtagtttcagagtttgaggtcttacatttaagtctttaatctattttgatttgattttcgtatgtggggagagataggggtctagttgcatttttctgcatatgggtggtccaggttttccagcacgatttatcgaagagactgtcctttctccagtatatgttcttggcacctttgtcaaaaatgagatcactgtaggtgtatggatttctttctggactcccgattctgttccattgttccatgcatctgtttttatgccagtaccatgctgtcttggttactatggctctgtagtattatttgaagtcaggtaacgagattccttcaggtttgttcttgcttaggatagctttagctattctgggtcttttgtggttccatataaattttaggaatttttttttctatttctgtgaatagaaatagtatcaaaataggtattttgatagggattgcattgaacctgtagattgctttgggtattatggacattttaacaatattgattctttcaatccatgagcgtggaatatttttccattttttggtgtcctcttcaattttcttcatcagtgttttatagtcttcattatagagatccttcacttctttggcctagttaattcctaggtgcttaattttatgtgtggctattttaaatgggattactttttaaatttgtttttcaggtagttcactgttgccagatagaaatgctactgatttttgtatgttgattttgtaccatgcaactttactgaattagttgatcagttattagtagttttcttgtggagtcttttttttttttccaaatataagaccatatcatcagcaaacaaggataatttgacttcttcatttccaatttgaatgccctttatgtctttgtcttgtctgattgctctagctaggactcctagtactatgttgaacaacagtggtgacagtgggcatccttgtcgtattccagttcttcaaggaaaggctttcagtttttccacattcggtatgatactagctgtcagtctgttgcatatggcttttattatgttgaggtatgttccttctatacccaggttgttgagggtttttatcaggaagggatgttaaattttttatcaaatgctttttcagcatcaattgcaatgatcatatggcttttatccttcattctgttgatctgatgtaacaccttgattgatgtgtgtatgtagcaccatcctcgcaacccagggataaatcccacttggtcaagattaatgattgttctaatatattgttgaattgggcttgctagtatttggtggaggatttttgcatcaatatgcatcagagacaatggcctgaagttttctttttctttcattctttttgttttctgatgtttctttgtctggttttggtatcagggtaatactggcctggtaaaatgagtttggaagtactctgtcctcctctcctttttggaatagtttgagtaggattggtatcagttcttctttaagtgtttggtagcattcagcagtgaagccattgggtcccaggcttctctttactgggagagtttttcatatggctttgatctcgttacttgttattggtctgttcgggttttggattcaatcttggtaggatgtattgtatctaggaatttgtccatctcttctaggttttccaatttattgacatatagttgctcatagtagtagccactaatgatcctttgaatctctgcagtatcagttgtaatgtctcctttttcatttctgattttatttgcgtgtatcttctttcactttttcttagttagtctggctaaaggtttgtctcatttgtttaacttttcacaaaatcaactttctgtttcagtgattgttcagtgtattgttttcttcagttcaatttcatttatttctgctctcctctttattatttttcttctactaatattgggtttggtttgctctttcttttctagttctttaagaggcatcgttacattgtttatttgaaaattttcctcttttttgatgtaggcacttatagctatgaacttccctctgagtactgcttttgccatatcccagaggttttggtatgttgtgtttccattgccattcgtttcaatttccttcttaatttctgcattgacccactggtcattcaggagtatattgtttaatttccatgtatttgtacagtttccgaaattcctcttgctattgatttctagtcttattctattctatcgtggtcagagaagatgcgtgatattatttcagggttttggaatgttttacgacttgttttgtgacctaatgtatggtctgtccttgagaatgatccatgttctggggaaaagaatgtgttatctgcatctgctggatgaatcgttctgtacatatctgttagatccatttggtctacagtgaagattcagtctgaggtttctttgttgattttctgtctggaagatctgtccagtgctgaaagtggggtgttgaagtctccagctgttactgtgtcagggcccatctctctctttagctctagtaatatttccttcatgtatctgggtgctccagtgttgagtgcatatatatttaaaattgttacatcctcttggtgaatcgacccgtttatcattacatagtgacgttctttttcttttcttatagtttttgtcttgaaatctattttgtgtgatataagtatagcggctcctgctcttttttggtttccattggcatggggtatctttttccatccctttatttttagcctgtgtgtgctttataggtgaagtgtgtttcttctaggcaagagatcaatgagccttgtttcttcacccattcagccagtctgtgacttttgatgggagagtttttccaatttgcatccaatgttacggttgacatgtaaggacgtagtcctgccattttgttatttgttttctggttgttttgtgatcttctcttcattctttctttccttcttgtcttcctctagtgaaagtggttttctctggtgataagatttagtttcttgctttttattttttgtgtatccattgtatttttttttttttttttggtttgaggttaccatgaggctcaataatactatcttataacccattattttaacctgatagcaactgaacactatttgcacaaacaaacaaacataaagcaagcaagcaaaaagaaaactaatgaaaactctgtgccttaacttcatccccccacgttttaatattttgttgtttctatttctatatcattgcattgactatgtctcaaaaagttgttctagttattaatttttattggttcatcgtttagtctttctacttagggtaacacgagtttgtacaccacagttacagtgtcattgtattctgtgttcttctgtgtccttactattaccagtgacttttgtaccttcgggtgataatttattgctcattaacgtccttttctttctgattgaagtacacccctcagcatttcttgtaggataggtctggtattgatgaaatctctcagcttttatttgtctgggaaggtctttatttctccttcatgtttgaaggatatcttctagggtatatactattttagggtaaaagcgttttttgtttttttgtttgtttgttttccttcagcattttaaatatgtcataccaccctctcctggcctgtaaggtttccactgaaaagtctgctgccagacatttggagcgccattgtaaattacttgtttcttttctcttgctgctttcagcatcctttctttatccttgttctttgggagtttgaatattaaatgccttgaagtagtcttctttggattaaatctgcttggtgttctgtaaccttcttatacttggatattgatatctttctctaagtttgggaagttctctgtaattatctctttgaataaactttatactcctatctcttcatctccctcctctttaagcctaataactcttagatttcccccttcgaggctgttttctaggtcctgtaggcatgcttcatttttgtgtattttttcttttgtctcctctgactgtgtattttcaaatagcctgtctgcaggctcactaattctttctttctgcttgatcagttctgctatcgaaggactctgatacattcttcagtatgccagttgcatttttcagctccagaatttctgcttgattctttcagattatttcagtctctttgttaaatgcatctgatagaattctgaattcctactctgcattatcctgaatttctttgagtttcctcaacaaagttgttttgaattccctgtctgaaaggtcacatacctctctgtctccaagattggttcctggtaccttatttagcttatttggtgaggtcgtgttttcctggatggtgctgatgcgaatatttttttcttcagtttctgagtatgtgaactgttaggtattaattgtagtcttcactgtctgggcttatttgtagccgtccttcgtcagaaggcttttcaaatatttcagaggacctgggtgtttggatctaagctgtgtctgcttcagggggcaccccaagctcagtaacgctgtggttcttgtagactcatagagggcaccaccttgatggtcttggacgaggtccgggagaattctctggattaccaggcagagactcttgttccctttccttactttctcccaaacatacagagtctctctctctctctctgtctctgttctgagccacctaaagctgagggtggaatgacacaagcacccctgcagccaccactatgcggccaccactactatgactgcactgggtcagacctgaagccagcacagcactgggtctcccccaaggcctgctgtaattactccttggctactgcctttgtttgctcaaggccctggggctctacaataagcaagtggcaaagccagctaggactgtttttcccttcattggagagaggtcccccaagccccaggtgggtccagaagtgccatctgggaatcagggactagcatcaaaaaccttagaaggctacctgtggttctaagtattgtggctgagctgtcactcaaaccacaggacgcagtctttcccactcttccctccccttcccaaaggtacaagagcctcacactgtagccaccgccaccctaggccccgagcagtactggcagactactgccaatgttcccttaaggctcaaggtctcgtaagtcagctgtcgtgaatgctgcctggcctgggactcacccttcggggcagtgggctcccctgtggctcagggcaggtccagaaatgcagtccaagagtccagtcctggaactggggactccaagggtctgcttgatgctctaccccactatggccatactggtacctaagatgcaaaacgaagtcccctttacttttccctctgcttttctcaaactgaaggagttttgccccatagccaccacttgctggttatgtaccaagtctcacctgaagccaacaagtctcagaggttcacccaaggccctcgatgtagtgcctgggcatcactgctggttattcagggcccaggggctcttcagtttgcaggtggtgagtgctgccaggactaggtcctttccttcaaggcagtgggttcccttctggcccaggacgtgtctaggaatgtcctctagtagctaggtcctggaacaggggccacgtgactctgactggtgccctatcttgctatggctgggctggtatcccagatgcaagacacagtcttcaccactgttttctttctcccctcctcaagtggaaggaaggggtctccttcggagccacaaggtgtgcagcctggggttaggggacgggtgatgccagcactcccttggctgccccagctggtatctcagtatgtcgtgtgaccccccccctcccccgacccctggtccactgtctctgggcctaattcaacaccaggactcacctaagagttgcagttcttttttttgtttgtttttttgagatggagtctcgctctgttgcccaggctggagtgcagtggcacgatctcagctcactgtaagctccgcctcccgggttcacgccattctcctgcctcagcctcctgagtagctgggactacaggtgcccgccaccacgcccggctaatttttttttttttttgtatttttagtagagacggggttccaccgtgttagccaggatggtctcgatctcctgacctcgtgatcctcccgcctcagcctcccagagtgctgggattacagccgtgagccaccacgcccggccagagttgcagttcttatggcctagtctgcctttcaaatttacttggagacacagagtgctgtagcctgccatggtgaggtttgtgggaactcaagttctgatcactgggatcagtgattcccctctggctagggctgctttaaatgctccctctgttgggggggcatgagctgagtttggtccggttttcctttctgctctaacaggatagcactgaggtcattgcttcacaaatgctgtggtctccctccccctgcacccagagatgctctccacaccatgctgctgtggccaggggtgggggaggggtggcgtcggtaattcaggactatgttttggttctcagggagaatgcttccaggttttggcctttgagtaggatgttggctgtgggtttgtcctagatgactcttattattttgaggtatgcttctctgatgcccagtttgttgagggtttttgacatgaagggatgttgaatttcgttgaaaacctcttctgcatctattgagatgatatgtggttttcgtttttagttgcgtttatgtgatgaatcacatttattgatttgcacatgttgaaccaaccttgcatcccaggagtagggcctacttgatcgtgatggattagttttttgatgtactgctggaatcaatttgctggtattttggtgaggatttttgcatctaggttcatcaggaatattggcctgaagtgttgtattttcactgtgtctccgtcaggtttgggaatcagaatgatgctggcctcgtacaatgagttagagaggagtcccagttcctcaaatttttggaatagtttcattagggattggttacagctcttctttctgtgtctgatagaattggactgtgaatccgtctggtccaggcctttggttggtaggtcttttttattactgattcaagtttgaaactcgttattggtctgtccagggattcagtttcatcctggttcaatcttgggaggttgtatgctcccaggaatttatcgatttcctctgggttttctagattatgtgcatacaggtgttcataatagtcgctgaggatttttgttgttgttgctgcatttctgtggggtccgcagtaatgtcacctttgtcatttctgatggtgtttatttgggccttctctctctttctttcttttccttgtttgtctagctagcagtttgtcgagcttatttattttttcaaaggacctttggttcctttggtttctttgaccttttgtagggtggttcacatctcaacttctttcagttcagctctaatatttgttatttcttttcttctgctagctctggggtcactttgctcttgtttctctagttcctctaggtgcgatgttagattgctaatgtgagatctgtctgactttttccatgtaggcacttagcaccataaactttcctcttaacactgttttagctgtgcccccagagattctggtatgttgtacctttgttttcaatagcttcaaagaatttttttgaattctgcccaaattttgctctttactcaaaagtcattcaggagcaggttgtttaatttccatacaattgtttggttttgagacatcttcttggtattaatctctattttcattgcactgtggtccgagagtgtggctggtaatgatttcaggtttgtttttgaattttttgagaattgctttacggccaaacatgtagtcgaccttataatataattgattggttttgaaagatctatatataattgtttgcctctgagagatcttcctgctacagatgtctatttttattgcactgcggtctgagagtgtggctggtatgattccgggtttgtttctgaattttttgagaattgctttatggctgagcatgtggtcgaccttagagtatgtgccctgtgcagatgagaagaatgtatattgtgttgttgtttcgtgcgatgttctgtggatatctgttaggtcaattctgtcaagtgttgagtttatgtcccgaatatctttgttagttttctgccccagtgatctagcactgtcagtggggtgttgaagcctcccactatgattgtgtggttatttaagtttctttgtaggtctctaagtgattgttttgtgaatctgcgtgctccagtgttgggtgcatatatattaaggatagttaagtcttcttgttgaattgaaccctttatcattatgcagtgcccttctttgtcctttctgatcattgtgggtttaaagtctgtttcgtctgaaataagaacagcaacctctgctcttttctgttttccatttgcttgatagatctttctccatccctttactttgagcctatgatgggtgtcattgcatgtgagatgggtctcttaaagacggcatgcagttgggtcttgcttctttatccaacttgccactctctgccttttaagtgggggcgtttagcccatttacattcaaggttaatattgatatgtgaggatttgatcctgtcactgtgccgttagctggttgttatgtagacgtgattatatagttgcttggtagtgtcagtgggctgtgtacttaagtgtgtttctgtggtgacaggcaacgaccttttgtttccatgtttagcgctcccttaaggacctctggtaatgcagatctgggggcaatgagttcccttagcatttgcttgtctgaaaaggattttatttctgcttttcttatgaagcctagtttggttagatatgaaattcccagttggaatttcttttctttaaggatgctgactattggctcccaatctcttctgacttgtaagagttctgctgaaaggtttgctgttagcctgatggggttccctttgtatgtgacctgccccttctctctggctgcttttagtggttttcctttcaccttgaccttggagaatcttatgactatgcatcttggggatggtcatcttctgtagcatctcactggggttatctgactctcctgaatttgcctctctacctgtctagcgaggttggggaaatgtctgtgggcaatatcctcaaatatgttttccaagttgcttgctctctccctctctttgtgggacaccaatgagtcataggtttggtctcttcacataatctcatatttcttggaggttttgttcatttttgttaattctttttttccttgttttagtctgattgatctgattcaaacaactggacatcaggatctgagattatttcctcaggttgttctagcctgctgttaatacttctgattgtattatgaaattcttgtagtgagttttttagctcaagcaggtcagtttggttctttcttaaaatggccatttaatctttcacctcttgtattgttttattggattccttatattccttggctgccatgtcaactttctcgtgaatctcaatgatctttgttgccatccagattctaaattttatgtctatcatttcagccacataggtctggttaagaaccattactgcagagctagtgtggccatttggagacaagaagacactctggcttttagcattaacagagttcttgggctggttcttcctcatctgtgtgggctgacgttcctttaatgtttgaggttgctgtcctgtggatgggcctttttgcttttacattctttgatgaacttgaggttttgatgtggtataagtcaatttagtcaattggcttcatttctggatgattttggggaaccaagacacagctcagcgctcctgggctgcatgctctacccctgggggctgggacgtgtccatggttttttttgtttgtttgtttttgtttttttttttttttctggactctgaaggtttactgcctgctcttctggaggggctgaggtgttcccattccgctggcaacagcactctgatgggatgttccggccaaagtacttccgtggggcagcggtagggcagcaagggcccccaaatgcatgggctcaccagcgaagcagtgcaggaaggctatgagtgagagtgcatcggtggaggagggctgcgggagggtgcacttgtctgcaggggaccacctgcagaagatccccaactgctaggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtggtgaggcttggggttgggtgcccatggccatgcttcagtgcagcttttcccatgctaaaccctctggactccatgcaggcaagatttctatctctgccagctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcagggtctgtgtccttcctccatccattttcaatgccttctttccaaagatctgtttggaatgtgctggtcttcttgatgatcgggtctcttattgggaggagttcttcctgtctgcatctggtcagccatctttgccccaaagccttcagtaatttttaaatctgagaatgtgttaattttccccttcatttttgaaggatggttttgctggatatgtaattcctgcttgacaggtttctccttttttagaactttgaatatatcgcctactgcttgaggactacatatctcttatgagatacagtctccttactagttatagtaaggagttatcagtaataggaattatcagtaatcaaaaccttccaacaaagtcaagtcttgggccagatgacttcattggtgaattctaccaaacatttaaagaagaattaccaccattccttctaaatctcttccaaaaaattgaagaagagggaacacttcctaactcattccataaggccagtgttagttaccatgataccaaagtctgccaaagccacaacaagaaagctacaaagcaatatcccttatgaataccaatgttcagaatcctagatgaaacgctagcaggcagaaccttgcagtatattgaaaggattacacacccatgactgaatgggaataattgctgaaatgcaaagatgattcaacacatgaaaataaacccatgcactatattaacagactgatgataaaagaccgcatcaccatgtcaactgatgcagaaaaagcacctaacaaaatccaacatggttttataataaaaaccctcaacagattaggaagagaaggatacttccttagcgtgacataaaccatatatggaaatacctatagctaacgtcatactcaatggaaaagactgaaaggttttcccctaagatcgggaacaggacaaggatgcctgcttttgtcacttctaactcaacatactattgaaagctctagacagagtaattaggcaagagtaagaaatagaaggcatctaagatggaaaagaagaagttatcccctgtcacagacgacatgatcttctatgtagaaaaccctagagattccacaaaaaaagctgttagggctaataaatgaatttgtcaaagttgcaagatagaaaatcaacacaccataaccagttgcatttgtgtacactgacaatcaacagtccaagaataattaagaaaataattacatttacaatagcacgaaaagaatagaatactcaggagtagacgtaatcaagacatttaccttgagaactacaacactgcttgaagaaattaaagaagacataaataagtggaaagatgtcctgtgttcatgggttgtggttaattttgcgaaaaagtctttcctgctctgaggacataaacttaggcactctcgtaattgttctaacattttttaaaatttcaatagtttgggggcatacaggtggattttgattacgtggataagttcttcagtggtgattcctgagattttggtgcacccgtaacctgagcagtgtacactgtacccaatagatagtcttcttttatccctcaccctctttccacctttccctccgagtcccctaagtccatcatgtcattcctatgcctttgcaccctcataggttagctcccacttataagtgagcgcatacgatattaggatttccattcctgagttacttcacttacagtagtggctttcagctccatccaagttgctgcagaggccattatttcgttccactttatggctgagtagtattctgtggtgtatatatgccacatcttctttatccactcgttgattgatgggcaataaggttgcttccatatttttgcaattgtgaaatatgctgctataaacatgcatgtgcttgagtctttttgatataatgacttgtcttcttttgggtagatacccggtagggggattgctggatcgaatggtagttttacttttagttctctaaggaatctccataccgtttcccagaatggttgtactagtttgcattcccaccagcagtgtaaaagtgttcccttttcaccacatccactccaacatctattattttttgactttttaattatggccattcttgccggagtaaggtggtatctcattgtggttttaatgagcatgtccctgataattagtgacggtgagcattttttttcatatgtttgttggctggttgtatatctttcttttcttttttttttttttttttgagaattgtctattcatgtcctttgcccacttttggatgggattttgcttttttcttgccgatttttattgagtttcttgtagattctggatattagtcctttgttggatgcagggtttgtgaatgttttctcccactctgtgggttgtctgtttactcttctgagtatttcctttgccgtgcagaagctttttagtttaattaggtcccacttgcttatttttgtttttggtgcatttgcttttgagttcgtaggaacgagttcttgtaaatttgtttgagttcattgtagattctggatattagccctttgtcagatgagtagattgcaaaaatttcctcccattctgtaggttgcctgttcactctgacggtagtttcttttgctgtgcagaagctctttagtttaattagatcccatttgtcaattttggcttttgttgccattgcttttggtgttttagacatgaagtccttgccgatgcctatgtcctgaatggcattgcctaggttttcttctagggtttttatagttttaggtctaacatttaagtcttcaatccatcttgaattaatttttgtataaggtgtaaggaaggaatccagtttcagctttctacatatggctagccagttttcccagcaccatttccaaaatagggaatcctttccccatttcttgtttttgtcaggtttgtgagagatcagatagttgtagatatgtggcattatttctgagggctctgttgtgttccgttggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttacagtagttttttccaattctgtgaagaaagtcattggtagctcgatggggatggcgttgaatctataaattaccttgggcagtatggccaaaacaaccccatcaacaagtgggcgaaagatatgaacagacacttctcaaaagaagacatttatgcagccaaaagacacatgaaaaaatgctcatcactggccatcagagaaatgcaaatcaaaaccacaatgagataccatctcacaccagttagaatggtgatcattaaaaagtcaggaataacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacgtggaaccaacccaaacgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcgctcataggtgggaattgaacaatgagaacacatggacacaggaaggggaacatcacacaccggggcctgttgtggggtggggggacgggggagggatagcattaggagatatacctaatgttaaatgacgagttaaggggtgcagcacaccaacatggcacatgtatacatatgtaacgaacctgcacgttgtgcacatgtaccctgaaacttaaagtataaaaaaaaaaggaatgaattcattacctaagccaatgtctgcaagagtttttcgatggtatcttctagaatttttgtggtttcaggtcttagatttaagtctttgatctatcttgagagttgatttttgtaataaggtgagagatgaggatccagtttcattcttctgcatgtggcttgccagttttaccagcaccgtttattgaatagggtgccctttcctcgctttatgtttttgtatgctttgtcaaagatcggttggctgtcagtatttggcttcatttctgagttctttattctgctccattggtctacatacctgtttttatgccagtaccatgctgctttggtaactatagccttgtggtataatttgaagccaggtaatgtgatgcctcctgatttgttctttttgcttagtattgtgttgattatgcgggctctcttttggttccacgtgaatttgaggatatattttttttctagttctgtgaagaatgatcatggtactttgattggaattgcattgaatttgtagatcgctttgggcagtatggtcattttcaccatattgattccacccatccatgagcatgggatgtgcttccatttgtttttgtcattgatgatttctttcagcagtgttttgttgtttttcatttagagacctttcacctccttctttttccactaaggtttcttttttttttttttaatttctggaatttatattgtgtatggagtgagatagcaatctcctctctaaaaaatgggtataaccaatggatccagcactatatattgaatagcctgtcttttcttcagctaaccttcaatggcaaacctctcatgccacgttttcctatatttaatgggctctctatcctatcaattgtattggcctagatgtcatataagtgaactatcttaactatcttaattattaaaacttgatatcttgtaagccatgtcccttctgatcccctctactttgttttaatattcttggatattaagcgcccttggtccttcagtatgcattctagagtcatagagtctattgttccgtagaaagctgtgttggattttttattggaatcacgtcaaatatacaggttaagtggagaaaaccgtcatctttatcatagggattcttccatgagcatgctttatatctgcctaatttggaactaatagctctcgataacatttgataattttctcatttaaagtctgaagcatctttgttagacttatttccatgtaccttactattttgtggcagttataattggtgttcattgaagagttgtttttcctctaagtggttgttgctggtttgtaggaatacagttgattttcttcttagctgtaattaatgctgagagtttgtagattatctcaggtttttccatacaggtaaataatatattgtctatatagatatgatcgtttgggtgtttttaattccaatcattatatcttttatttattgcactggctagaaccgccactgttgagcagaaatgacaatattgagcaaacttgtcctgttcttgatttttaaggacaatccatgtaaatcttcaccagtgtgcacagctgttggtgcagattattttgtagatatgtgttttccatctgttttttcccagtttggcaagaattgtgttttggtttgtttttgtgtgttccgtgaacaggcactggattttatcaaatgattttaccctgtccattaaaatgatagcccaatcttgtttctttccattaatgggatgatttacattaacattcctttctaatgttaaggcatttttacactgctgtgatacaccaaacttgttctggtttattatcatttctgtgcgtcacttaagtctgcagtatttaatttagcatttagcttgaattataaatttcctttctcctattatacttacctcattttagagtcaagattatcctcataaaatatacttgggagtgtaagcttttatcttggtctttggtgaagtttgtatgaacttggaattaattatctactccttgaatgtttagtggaattttccccgtgttcctggtagttttcttgacgttgttttttttttttttgaactaaagatctattttttttaatgtcaacttttatttttagatagaatggttacacatacaggtttgttacatgggaatattgtgtgatgctgaggtttggggtgtggatcccatcacccaggttttgagcatagtatccaataaataggttttcaacccatatcccctccctgccccctcgagtagtccacagtaatttctttaatcgttgttaagtctagtcaagttttctatttcttctatagttagtttaggcaggatatgtttctctttcaaaatttctacgttgtctaggcattaatttatatcagtatgaaattgtttttggtattatcttgtttattgtttatgtctaatcatattctgcttgttaatttttaatattgttcctttgtgttctctctctctctcctcctgtccactgctcttcatctttctcccttcaccagtattgccaacgttggctgtttcgtcagtcttttcagaaaccaacttttggtttggttgattttgttgattctctctattgtacttttctttctctctttctttccatatatatatatatatatatatatatatatatatatatatatatatttagttttgtttgttttttttgttttgttttgttttttgagacagagtctcactctgtcacccaggctagagtgcagtggcgccatcttggctcactacaacctccgcctccctggttcaagcgattctcctgcctcagcttcctgagtagctgggattacctgcgcgtgacaccacgcctggctaatttttgtatttttagtagagacggagtttcaccacgttggtcaggctggtctcgaactcctgaccccgtgatccgcccgcctcagcctcccaaagtgctgagattaccatgcccggcctctattgtacttttcttttatacctcattgctttctcgcctcatattattttttctttttatttttctgcttttcttttgctcttctttcaagcatggatatgactctacacagctgcacccaggggtgacctttaaagacagtgcagagaaaagtatctccctgttgtggggtggggggacgggggagggatagcattaggagatatacctaatgttaaatgacgagttaatgggtgcagcacaccaacatggcacatgtatacatatgtaacaaacctgcacgttgtgcacatgtaccctaaaacttaaaggattaaaaaaaaaaaaaaagaagtctgttgaaaagatacactatggaccttgggctcaaagacctacggtaggaagctctgagtaggatgtgagaaaaatcaatgtgacagtgaaaaacaattattatgtacaactcttttatattctaaagaagggggttaagaataaagatccttgatgtgctgatcagggtgatgagtctgaggattcagtcatcagaatctcacagagataaatggctccacagagaaaagagatttgaagggaatgagactgttcaggaagaacaggagctgatgcccatccatctcatgagggtatgaggaagagaggcaagatagtctaacgcagactgtttggtgacatttcactgggacacgtgccattgaatctcccccgtttgtccccatgaagacgtctacaaatgcgcattgaatgttttggtaatcagatttatcattggtttgggggtggggggtgaatttcagcatctactgtcaagcggggcaagagcaaaggtagctcttggcgccctaatagtactctgcttcaataagttagctgtggtcattgcaaattatgtcagcagaagttgagtggttaaacatgggctttaccttcagagaaacggaacaattctgaaaaagaagaaaagagagaagatccaaacttgccacaggcacatgcagcaggttctccagtcctctttagagtggtttagctgtttaaaaacattgggtgggttctggcacgtgcctagtgttttccactcttaccctgtttatgcacctctgtcctgcttccttgatcagctgcccaccagtcctgagattctcccaacatggatcacttctcagtcattgagaagggaatatgagaggaggtctagatcattatgttcttatttggcagtttaattgttaaaaggaacattcaccaatatactcccacctcgacacccacagaacgtaaaaataaactgttgtaggatgtggtacagtggctcttacagggtatactagagaagaatgaggatgtgaagaaaactggggttcacattgagcctggggtggaaatcctggctgttcagggtggtggaaagtgtagggctgattgccattcctatgatgccttccttgaatcctccggtaagtatccacatcttctagtctctgacttcgaccatatttatcacctctaataccagagttctgaagtttgtttcttgctggattagtttctgtggtcttctaaggacttatgacctatacgtctgttttatagcctataaaattttgctaacatatttttcttggtgtggtgtcgttgtctggtaccttctgattttttgtcccgctttgcaccccccgcccccccccacttcattattaggggttttctggtgggagcataaaaagcatttgcactcagtattcctgaagtaatcagaagtaaattgatagattctctaatgttccactaccctttcattcctggaacgaacgcttttttaatagacatatactagttaagtttagtaataattaatttagaagttttgcatctgtaattatatatactataatttttactgctcgtactgtcctttttgaactttcagtgtctaattttaccagcctcatgatagagactttaaaaataatctcattgactttactgacaaatgtcttattatgtctgaaatataatggatctagaacctgaaaaaattagttaatgaaatgcactgaaatgaatggaaagtaggatactcttctatggtttttaaaaattgaggcatttactgagtcatatagtggcccccgccaaattcctgtccaccctgaacctgtaaatgtggcagtatttggaaatagtgttttttcagacgcagtcacattaagatgagatcatattgaaccaggcagggtaggccctaactccaatatgactgctgtccctataaatagaggtagatttggacaaggagacacagacacataggggagtcgcgtggagacagagacagagactggagtaaggcattacaaaccaaggagtgacaaggagtaccagcatccaccaggaactaggagagctaagaaaggcttcttccgtcagatggagcatggccctgctgacatcttgattttgtacttctagcccccagaactgtgtgagaataaatttatcttgcttttagccacccagtttgggtattttgttatggcagccctaagaaactaatgcagattttagtgctaagacgtgggttgttcctgtcacaaatgcctaaaaatatggaagtggctttgtaattgggtaatgactagaggctggaagacttgaggcacatgatatgaaaaccctagattgccttgaagagaccgttggtagaaatatgaatgctaaaggtgattcttgtgagagctccagaaggaagtgagaagagttgtagaggaagtgcttatcatcttagagaacacgtgtatcattatgaacagaatgatgctagaaatatgaatattcaagctgcttatgatgccgtctgagatggaaattagacacatgttaatgagcactggaggaaaggtgacccttgtgatagagtgtcagaaaacttgaatgaattgtgtagaaagcaggtcttgtaagcgacgaacttggatatttagctaggagatttccatgcaaactctggaaggtgtggccttgtctctttatagtaaaacgtgagagtaaagagataagttgaggaaggaactgttaagccaaaaggaagcacgcttgatgatttggaaaattcacagtctacccagatagtgcactatggaaacagggccaaaagtgtggctgaacagccatttgctaatgagactagctaggcatgtggacccaaccaaccaccttggccctaagccaggaaaccagataggttaatccaggaaggacccacacagagcctacatatctagttgtgtggatccccttggcatctgcaaaaacatggcaaggattttgagagttttatactagcagaaacgctgccagcctggactgaaatgtccagagatgggacaaaaatgaaagaagaatgtctctgaaggcagaaacatggaagaccagaccagaaatggcattgtcattaccctggagggctggatggactgagtccctgacccagaaagccaggaagatggggctgcctccctggagggtcctaaagtttggggctgcctccctgaagggcccttgggacagaagattgagccatggaagttcactctcggcctgaaacttaatggacttttttcctgctgggttgtgaacctgccccagagcgacaacccctttaatctttccaccttctcccttttgtgaaggggacgtctaacctacgtccgtcccactgtagtattctggaagtagataacttgttttctagcttcatgggtctgcagacagagaggaacattgccccagggtggaccttgcccaaagtctactcggtaagatcctgacaattttagatgagattttggatttagggttaatgctggaataggtgaagatctggaggatttggagatggggtgaatataatttactcacggtaagaatgtaaatattggggagccagagggcagactctattgggttgaatagtgcgtgcacccccctccccaaatttatgtctacctggaatctgtgaaggtgattttaattggaagcaaggtctctgtagatgtaatcaagtgacgataaagtcacactggactagggtgtgccctaatccaatgactggtatctttataagaagaggaaaattgggacaaagagacagacacacagggagaataccatgtgacaaccgaggcagagattagggttaagctgccacaagccaaggaatgccaaggattgccagcaaccaccagaagctaagagagatgtgtggtacagattctctctttaactgccaccctcaccacaaggtaccaatcttgctgacaccttgatttcaaacgtttggccaatagaaatgtgagagtttaaaattctgttgtttcaagccacccgtttatggaaatttgttatagcagcctgaagaaacgaatacagcacttgagtcctgtttagcaaggatcaagctagagctctttggtcactgtgtctagcctggtgaacatcagtggctgcttggggcagccatatggacattatttgtgattgtgcatccctgagatgggcctggggatgagcccttgtgagttatgcaaaaaaaaaaaaaaaaaaaaaaaggaaggaccccagcaccccagggagacttaagcatggcaccaagttgcctaacagtcattgtttttcaggcatgggtaccacagttgctgccgtagcatgcattctccttaccctcaagcgtattcatgtgcatagccatggcagccggtgtcccagggactgatgattaaataaagagggtggtggaggaggagcgtttggcactcagctgctcccacagtgctaaaccacttagcccttattctatgcagagctatatctaagtttcatttaattctcacgccaaattgaggatcatgatggaaaattttgtctatagctaaatagaaagctgaaactaagaaaggtcaagtatcatgaagtaaaagagaggttctattagtaatagcaaaaacttggacttcaagcactgtgttcctttcatttgtttttaaattttatttattttttaattagacaaaattgtatatatttacggggtacaatgtggtattttgataagtgtatacatttagaaagactaactcaagctaattaatatatccatcatctcacctacttatcacattttgtgttaagaatatctaaaatctacttttaaagcaatattgaaatatatgatacgttgttattaactctgctcactatgctgtgcaattgatcaccaaaacatattcctcctgtctaactgtgctccagtcccaaatcctcagcagtaaaatgcccctgtctctcctcagtgaaaccactcttgattaataaagtagtcttagtgtagtcttacctggggcttagttgtcccagatctttcctgccatccaccagaacctctttgcctgtagagagtcttctgaacttgagaagctgcaggattatgaaagcccagcatgtcatacacttgcctgctcattgctccttctctcaccttggctctcttgtctctcatagcaatgtcatctcaatatcgggcatcatgaacataactcttccggcctgtcacagaaatgaagcaaataaactgatggaaaaaaaaccataaagaaacccacaataccagccacaagtcaaaccatttaaaactgttacttttgtattagtatcagacaaaatagacgttaagacaacaataattatttggaataaagaaggccaccatgtagtcatgatagaacatttatcaaagagctaaaaagtctgaacttaacatgcactcaaaaacatagccaagaaatacataaagcacgatgttcagagttacaagaaggttgccacaataaaatataaaagtgcactattttagagttggggcagttccaagaagtagcaagatccagggagtgcccctgagcatggcagtcaaataagaggtcttgcgaccatgaggcttggaatcagactggttttctacatggacattgaaatcacccaggactgtgacaagattaggtgtagaaactctgaatgagacataaaaatctttgaccaaaagaccaatacgttggttttattttagaaagccatctttgtaagatgcccaggatggccataaaattgaatgtgtattggtcagggatatttaaactacaactaacagaaagtgcaagtctcgctggcttatccaataggtaaagacacttgcttatataactgagagttcagaggcagagtgagtttcatggttaactgagccagtaacggaaagatgtaaacatccaggctaaatcttgacccaaccactgctggattgggcattggattattggattagattagactaattctgggcccactcttggagctaagaaagtggccatatatcctcaagcacatgactctactgggaggagatacactgatggaggcctgagcccagccaggaaggtgaggaatgtatattgtgtaggtaaacaaaaatgtcacctgcaggtacagactcaaattatatataccgctatgagcatagtaaccacaatattcaagtccttcttgtgtcctaatagagtgactcttcgggtaacaaagacggatattttattcaggagctacctatattgaattcatgaataggcggttacaaagcatgagagctctcccctgtgcagtatatgttttggaagaacctcaacaggcatccactgtgggatgcttaaatcccattttcattctttttcgattcgtcggcaaagttttctattcgctcttgtcctgagatgatgttgtgttaggattatttgaccagaggtaactgaattcttcgtatttaccgttaagttttgtctttctgtaaacacgcgacacagacttcacaaagatatcaaagatcctcagatttcagtatggaacaaccttaaaagccctgggtctttagaagaaagtcagactcagccaggcgcggtggctcacgcctgtaatcccaacactttgggaggccaaggcgggctgatcacgaggtcaggagatcgagaccatcctggctaacgtggtgaaaccctatctctactaaaaatacaaaaaaattagggcttggtggcacgcgcttgtagtcccagctactcaggaggctgaggcaggagaatcacttgaacccgggaggcggaggttgcagtgagccaagatcgcaccactgcactccagcctgggcaacagagcgagagtccgtctcaaggagagaaaaaagaagagagtcagactcctataatgtaccaaaattaaagaacaaccttttcctctaatgcacacatttattcacgctttgaaaagaatatgtttccataacaataccaaatatgcatatgaaaagaaaattaaaaataagataatcacccaatctgcgaatatgcagatttgaaaattaattatcaatatataaatggaagctcttaataaagacgttgtagtatcacatagacaagatatgtaatgtgttattgctcatgttttgccttagtctgcatctacactgtgaaatgagcttaatcgtgttcactggttcattatttgctaactccttgattgacttagccagttgagcaatccagccagtgagtcattctataactgttgataaactacgtgatgttttaaatccaaggattaaaagaaaacacaaacattatatatcttgccttttttcacaggatctaatcactgataataaattatcagtgataagctgatcacaagaaacaaggtataaatgctgcatacactaaaaagaaaacaatgtggctgactatgttttaaaaattatctgacagtattttccaacagagtatttagaactatttcttgaattgcaaaatatagttgccttgagcagataacaggaagcaatctgggaaatttaaaattctctacttttaatacattagaaatctttgaatcataattgctcattgttttaaatggtcttcacagtggagggggtttggaccagagagctgcatcttcacaaatggcactgctcttcagtaaacaccctctatggaatccctaccttttcactcctctccatcctttgcctgaaggaagttttccttgtagacataattttgtatttgtatgttgtggtagtcctcaaagagtgagcctattacctagagctgttgaattttaccttgcattgaggggttggcatattgagcaatttgccagggagcactatctgcaactgcttctctttttttcctattgcttggcactgacataaagttacttctagctacgctaatgaatttcacgaaggaacacagaaaaacaggtcttgaatgtaatgcccgtaatgatagagtcccatcttatgctttcccttgtatgctgttgctaggtcagtcatttttactttctgaaagttaatttacataggacacctagttcaggtgtatgtatctgttcaaaccaaaagcgttagagtatttatgtttaatttaacaacgtcgcaaccgttctgatacttaggggagttctgagtaagtaagttctagaaaggggagttccagtactcccctttctctcttttctgtgttaggtaaagccacccctcctaaagccactagcatggatccccaaaatgtccaccacagaacgaaaaggtaaaagaaggagaagttgttcctgttaaatcctgccgtatcacacgcaagagaaatggcttatcaacctgcctcaccccagtaaacacagcgcctaataaattcagtgcctaaactggaccccggacatatgaatctttgtccacagagttaccttcccccactgtttgtgcatattagagcaccgacagacttccattggtgtaacttaaaaaaaaaaaaatcctaacaaagtcctgataatcatctcagagaaagagtgaatgatatgagtatcaggtctgacaggagcaaactgtgaattaaagtaagagttataattaggatttgtcttttggtgaaagaatttgaccatcatcaataccgtgtaagttccagttgagcataggtgggctagataaaattgtgctgtgccttttactggtgatctgttcatctgtatgtaatgatagaaacgggggccagggcagataccaggtcttgaagtaggcttccatcctgtgactttgtatagatacttcctaaatccaacttgaaatttcataataggctctttcataaatatgtagccccattttatatcctctatttacatgtgtcccataaataattctccagaattatccgagacccactgattggcgcttcctagtcattcattccaattatcatgacttcagtctacggccataccaccgtgaacgcgcccaatatcgtccaaatatcatgacttcctttgataaccttagagccactaacacagcctgttgtcctcactagtatattcaactttaactgtggtggaaaatttggtctgttgagttttcttctgcttatttatgtagccaggccacagtgcgggaacctagcaaagtaatcccaatgcttgtatagcattgtttgcctctgcaagcaaatcagaaagactccactccaccaaatttattttggacatgcaggtgaagctgcagtttcccacacaaaccagcaaaacaggtggtcgtgaaattgcgattaacaacaactgcaatgtgtactctccttctcttttctctatcctttctggggagacacaggcagaataaaaatacagtgaaatctaattataattcagattccactcatacaaaattgttgcagttcaggccagagccaggtatgatgttttaaaagtgctaatctttctcttttcagtaatttttttaaagaaggaaatgttttcagctaacctcaaacattttatactgactttcatatatacatattttatatattaatggtaggtttatatgtatacatttaaatgaatctcctgaggtccttaattagattcagcattgactggtgctaattactgacagtacttgaaatttcttagttggtatttcaaagagaacatccaagacctcaactcttcagtaactgggtctggcttccagtttgtgtgaattaataaggctgaactaaaattaatttcctttggaaaacccgggggtggtcagaacagtctagcaccatactgcctgggggagacagctggtttgccacctgcaatgtctgtgacctcttaggcaagtgatttaacgcctctgtgcttcagtttcctcgtctgtaaaattctgttatactacctactccatagagttagcactcttaaatgcggtaaccttttggagtgtgtggcacatactaatcactatacacatttttctttttcaaatgaacaactaaaattcattaggtttgccctaatttcctttggccctgtatgaaattaagtaaacagtgcttacctgtacggactgcttaggctcttgcagtagtgtctatgattatggttttagtgaggaccttcttcattgtgaagtattaaatttcacgtgttgttagaaatgaaacacataaaatatattaaagagggatggggggccgggagcggtggctcatgctgtaatcccagcactttgggaggccaaggcgggcagatcacctgaggtcaggagttcgagaccagcctggccaacatggtgaaaccccgtctctactaaaaaaatacaaaaattagctgggcgtggtggtgggcgcctgcaatcccagctacttgggaggctgaggcaggagaatcgcttgaaccgggaggcggaggttgcagtgagctgaaatcatgccattgcactccagcctgggcaacaagagcaaaactccgtctcaaaaaaaaaaaaaaaaaaaaaaagtgaggtgagggtagcaaaagctcaagtctgtgtgctgtgggaggttatctggaggtaccaccatctcagtaatatgggcaatctcagagctccaggtctcatgaacagaacggtctcctgaaacatgcagatcaggagaactctgcagtggttggattctactgtcaggaagttgacccaagctcacccacctatcctgggtacttgagccttgcaggatcctaaggctgcaagccacgtggatgccaccatcatgtgaacactacaattatgagccctactgatagggccctactggtcatatcagcaccaagggctctaaaactttgaggtcatgtggcctctcttgtcatgttgctcctatggtcatgtgatgggcccagctcttccagtcactacagtatggtggactcctgaaccctgttgctcacatggattcttccctcacctggccattactggctaccagcatgtggaagtctcagccctcgaagtcatatagatgacctactgtttagggtcatgtggatgctatggtcatgtccactgctcccactcacccctccccatggccacagtgtcaggctcattcctctctgtcacgtgaagattgtgagctgccaaactctgcagatgtgtgtgtgggcagccaagtggctcctgtcatctcgtggcaggcaaagcctttgcggtcctgtgagcaccgcagctaaccaatggctgttgtacatgtggctcttatggtcacgtgagattccgcaccctcccattcacgtgaagattgagtgctccgaatcctgtcagagaggtgcttccggctccacaccctgactcaggcggaagttttattggacttcggctcagatctgaagccttccggcaactttcatatcctgacgcgctggaaggaagtctggtacgagtggaaccagccggtactagaagtttactgagaattgggctttaaggcgtggctgagcaatctccaaatagcagaggctctgagggggtggggtggggtggggtgggtggggggtgccgggggtgcgggagggtggggggtgcgggaggtgcgggagggtgggggggtggggagggtggggggtgcgggagggtcggggtgtatggggggtttgggtggaggtagcggaggacttccctaatgtggccgaacttgtgaacacctggcagagaaactgtgtgtgcgtgcgtgtgtgtgtgtgcgtgcgcacccatgcatctatgtctgccatccgccttgatcctggactcacaggagctgttgttggaggagaaggcactggggcagaatgtggggctgggggataggggtagggttggtagtggggcggcagggattcatgaactcgtaagtcgtttctcaggggcagggctgtggaagcctgatgggattccccccccttcccgcccccacactaaaagccctacccttgcctgtcactctgcccgattcaccgtctgtgccaggtgattctgtcctctgcccctcctcagaccatgttgttattaaggacactcgagactgcctagatcccagtttgtatagacgattccagacccaatcttaatttctgtctcttatttgattatgtaaagattctctttgtttccatgatttatttttctactaaaccttctaaacatgggctcaggggggtgggcgaaagggagagaggggaatcgggaatttttttaaaaagagaatttgatatttcaataaaagtgtccaagtcgtcatgatgtgaagattcagaatttacttgttatactttatttgaactccattggctttaaaaagtacatttgggagtgggtgacattttttttgtgtgtgtgtgcgcttaggatctctcagtagcttatagtagtatagcttcacactcttttgtttctgattctccccccatcaacccctgattttctaatgattgcttcttagattcctttctgaaaactctctccttttcttcctgtggaaaaaagtatagtgaatggatttaaggtacaatcatgggtgataacatttggtacatcatgaaagcggtattgggtgaatgaagttgagcaaatagcaagattgtgcttaaacttacggggtttcaaatattgcttgtcagatggttagagaatattgtcacttgtgatatttgatattacatgtaggttgaataatctatttttctctcatttcagcatttccaagttcgttctgtgagactgtagtgtcaggacaaagcaacaacaaaatgtgctctactctaaagaagtgtgggacatacagaactgaaggtaaacgaatactgtaggatttttttagatgatatgctaataaacaacacgagtctcaaagggggggctactttccccaacttgtatgggaatggaacatttttttccacagagcatttgaggtaccagtgttcttcagaaaatatttggggaaaccctgttcagactacatcttctaacactttaaaaccttgtgcctttgtttactcagaacaatggaatgtgggtttataatagttgtaatctagtctgctcattaagacattgattgttgctctttaattcattttatctcatgtcatcagtcagtctctcctgcttgaatctttgtacttttttactcttcagagataccgccaagcatgcatctgataccatggtggtggcagacaatatgtgcataaatgcaagtcattaggaagccttacctgtggcagcaaataaagtgcccccactcttgaaaacaaggtacaacttacctgtcaggacaagcagatgcagtaccgctcattttacacaataaaaaaccacacttcttcagaaccattttattattacttaataattacagctgccatagtttgagcccctgtcatatgtcaagcactgtgataacctcggctgtcatgcaagttactgcatttaaccctcaggaaagtcctgagagggtgttatcttaattgacagatgagatatatgagtcaggagaggctgagtgtaacgctgtgcttataggcaacccccaaacctcagtgacttatttctcactcctgctgcatgtttatgccaggtgcatatccttcacgggatggtggatgttgggttctgagccattcttattggaatgactcagagacccaaactaatggagcagccaccatctagaaaggggttactcactgcgtcagagtgggagagagccgtagagggtctcaaaccaacaaccaaaggttctgacccagaaataacccgtgtcactcgtcactcacaacccattggccagagctagtcacatgcacggccctgccccaaggaaggcagtcgggtcgggcagtcctaccaggtgcctggtacaggggagaatgtaaacacttggtaaatggcagcactgactactgcatgaaggaatcaaagctgggagggattaagtacttgcctaacatcacatcggccgtaagtgacagaatcaggatttgaatccacccaggcgtgatttcaaagtcgatgtcctttctgcttctttctacgctgcctgctcttctcttaaaggaagcttatagtaaaaattcttttacatcaatgatgcaatgccctcttccttaatcatctgatagtttaattgaatagacacgatggcactggttaaaaagaccagcactgataagccagaggtcttttccaaatgagggaatgtattggatatttgaatatccattgtattcaattataaaaataaaaccaggtggtagatgaaaggacttttcattgatcatttacttaatgtggaataatccccatgtcttaccgctatgttgaggaaaaatgataaaaaaatagagcctaccttgatgaaagtgaaaacaccatgtgagagagttgaacaaaattgctagatgtcagtgtttcagaagcgcaggataatgataaaatctctggccacacgggcagagaaaattagcgaggtggtgcgggtcagccacttttggaatgaagatagtgtcacacttacagtgacagaaaagattgaaaaagatcacattatgaaaaggatgtgaaaatttgaaaatttagattaaattgatgaattccaggggaaaaatatatataactttccaaactgaaggaatagaaaaccttggtttattcaatgtattcttgacaaggaatacatgcaaaggcaaaattactagccaacccgaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatcaagcgtatgtgccaacatgagactcagaggtggaactgaataacatgggagccatatgtggggtggactacccgtgatgagggaggtctccagttttcatgcggcagccattgcagagtttctagaattcagtctctgtcatgcatgtcaattaacgggcaggcagcagtggtatttcagctgtagcagttccatcacgtgggtggacttctcctggctgtgcagcatccaggcctgcttttctggccctcacagagtttttgtaagctatgtaatatattttattagagatatcttgtttgtataaaagagctagagtgaattctggcataggcaagttgggaccttgattaacagagtacttggcagcaaaattggttgcaagcaaaagaccttgaaggaaatggggatctggggtagatttggcccacagggcatagttgctgacctctaagctaataagttgctgacctctaagctaatagactcactgggtccccaaaacagtgctgagtgggaagtcagcaaaatgaggaggcagctattgctaggatcctctggcaagcataagccaaaaactgaggctttaacacggttgttttcaaccttggttgcacactgcaattcacatggagagttaaaaaatgtggttgcctggatctaaccacggttctgctttgattgttttgggtgtgtcctggtgctagtgaattgtttcagtgtccccaagtggctctaatgtgtaatcatggttgagaactgcttgaacaatttaaatcataagaatgcaagcctttcacaatatttaattttaaaattttataattgtggtttcagaatgataatattacagtaataataaatacatagttacgctggaaaatatgaaataaagattcccatgtaagacatcgagaagattgtctttttcaaagagaaaggaaatgggaaaacacagtggtaaagccggggccaccacaggttgtgtccggcttgaagctaaactgccggcaaggccagagcaaggtatggattaaagctaagtgtctgtgagcccagggctgattcagcagtggagcttcctctgcagaagacatccacaacccaggatcagcaaggaagggatggcacaaactcaacaaatccaataattggcactgagggaacagaaagaatggaagaggctgaaacagacattaagataatatttccccagagagacaaaggagtgataaaggatgaaattgtgtctattacgaaagaatagaagactgcccaagaaagatggctttttgaaggcaaggatctcctttcacttcctcctgaaacttcattaaaacaacatcaaaggtgaacaaattatggtatatccatcaaggggcttttactcagcaaggaaaagtcaagaacatggatgggtctcagaaacattatgccgagttaaagaagccagacccaaaggggtgcagcatgcacaagtccatttgtgtgaaatcctagaacaggaagatgaatatatagtaacggaaagtatatcaatgtttgcacggagccaagggatgaagaggagatcgactggaaaccttttgggttgtgttatatgttctatatcttgattgaggtggtagctagccctaatctctgatttttacatgtaaggaacctgggatcaggagaagttgaatgagtcgtcaaaagtgaggttagcttattaatcagagagaagatattcacacttgattgtcagtaataaacggtttccattatgctgtatatgggtcgataggaaaagtgcttctccccaagcacttgacaaaaccctgacccggccataaacatcctcttatacaagtatgaagcgtaggtgtgaaagtataaccattctgcattccagccacctacttctacacatggttgacattctcacgtgtccctttaccctgacttgtttgtgtttatatttacaaatgaaaacataacttctcattaatattttcttctgaggaatcatactgtaatatacagttttataacctgactttgtttttctttccctttgtatcacgtggcgtgacgagtattctaccttgttgcttatagtctgccacttaaacctgaaacatttcttgcataataatacatttttttttcctgaaagatcggaaacgggaacttaagctccctactgaatccttccgcataacctgtttcatgctctgagctttctgttttggttccctgaacccatatgtcagatgattctccactggagccggggctgccctgttttactactgccgctttgtaagatacattaatagctgacatggcaaccagatgccactcactcatctcttttccttgtcatttccaggaggactaataacaacgaatgcaactaacacgtatttctccctcaataaacgccagatgttgtactacgttctcgacatagtaatagacaacttatttatagtgcttgttaggtcacgggcatttctccaggtgcttttcacgtgtttccatgtgttaactcacttaatttttacagtagcccatgaggtagaaactgttactatctttgagttagggggaaaacaagcaaaaagaacttgagtcacagcgaggtcacttagttgccttggatcatagaatttagcaccaggattgaaatcctgatggatctgaccacaaatcctaggcccataaccaataatgtgcgactctgtgtcaaggctgaaatgagcagtacgacagggcccactcaaagtctgctgggcaatgatgggtgtggtttctggaaccaatgtcccgactccagccttctgtccaagagactcatcattgcacagtgttgccctataccatctctccttttttcggactgtgtgggaactgtttctctggtgttcaacttgaagtgaagtaacagggacagacaagatgtacatggacaggaaggaaggagggttttcagaggggagcatatcgccaggatgaattcagttccctggaggcgttttcaatgtgtgtttctttgtcttctctgtactcaccctcttctttctgacccacacatccatcccttggccttttcaccctgtatgtcaggtactcatgccccttccttgccatgtctacttcattgcaagggcagtcatttctacttctccctttgacaatatcagccactctctggtcccgtcatccttctgtcccaaaggacctgtaaagcacagccgtataattatatgtatatatttagacagagagtgatatatgtaataaattcgaaaagtgaaacgtctggatcaaagtgtaagaatgacttctgaatggttaggcatattgcagaaaattagactcacacacggttagtggaagtgtatattggtgtaaatatcattgaaaatccttacgaaaatatcactttatgcttaaaagtactcatgtgcttctcctgggaaactgtagagcagggactcaaaatcttaaacccacttcgaagccctggctgtgttccactgggttttttggccacccctgctgggggtactctgtaaccctggtcaacctgtgggtattgttccattacttttgtgtacagggaactctcctactttcttattttaaaactatcagttcaaatattaaaacaccgagaggtagaaaagaaaaaaagcactaaaaagcatattctgaacaagaaacaaaatttggccatatataatacataacacatgaaaagaaatgtgcagtgggatccagtgttgtgtggcaatgtgtttaccaacatgatttggagtacatgtatctgtaacctaattgtggaagcatgtaatacgaaacactaatacttgctcgcatgggcaacacggacacacagaccacacattcttccctttctctgagacagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggaggtactcagttctatttctaaggatacattaatgaaaaaatattaatgttgcagaagaaaagattaatttgttctagttttgcagtcaggttatgaaatagttctgcagcccgaatagctctggaataaatataaatagaggtcggtagaaatggttcagatggatgtattctcaaaagtggttttgtcgatgatcccaaacctacatcaaatgcattcatttaacaaatattaattaggcccttattctatgccagacactaccagcccaaagtgactcctaatctgaaaacccatggcccaaacagattacacccatctggtccaagacagagatctccaccttatccaagacacctggttcccaccccaacaggagtgactagcacaaaacatcatcccggcctgcttacaaaaaaatctgtcgatgagacctgaaagcttgccatttaagggagaaccagtgcagtctctggaggagcactcagggtatagaggcagaccaatatacgtgaggacataattcctgttctgccacttacctggctgggaaatgtacccgacatctgttaacccaatattcatgatctgaaaagggactgtggataaaattctcatgggatttctgtgaggaggtcaagagaaacctagtgagtctgcccaacactgagcagatgttggttgccactgggcaagggttggttttcttcttatcccgttctttccctgccgtagcagggatgctgatgccatgcactcagtggcatggcagtgatgtaggcagaattccaaactaacacaggaagtaccagtaggaacacacgtgatgtcataaaggttactcaccactatgtctgtgtggggggatcagccagtacatggtgggacttgaggggaaacccaggcggtctgggtgagaagtactagctgctttataatactcttgagatcgcccgtaattctggcagcacaactgcgagacagggattgtgctgagatgccagagttcagcaagtggatgtacgcctgtgtgtgttgtgtcttcggcatctctctctgtccggtccctctgtggctttttatcacatgtgctctcttccaacacaaggccttgcctgaggctgtagctgtagctgttggctagcttacacttttacaccttcttcccctcagtgacgttatttctgaagtaatgtgtgttctcaaaaatgactctgactcttcctgtgctccatatattgaccgtgtgcccttaaccctcactttaatctttgatttttttccctttcatttatggactttcatgaaaatgagttggtttctggacatcctccaaatgtcaccaataggggtctttgttgttgttgttgctgttgttgagtattgttatggactcataactttttaacatactgatgggctccaaaccgcggttaaaggattttgagtaaaggaatgacaagatttgacttatgccttaaaaaatcactctgcctcctgtgttgaaaatagatggtaggggagtcaagggcaaaagcaggacaacttggaaggcagcataatccaggagacagatgttggtgacctggccagggtaggtagcaatggagggggtgagaagtggccagactctggatatattttaaaggtagagccaagagaagatacatccatcctgatcggttggatgtagagtgtgagagaaagagagcactccagccccacttccaagttgtagggaccaagcatcaggaatgtctaggtcagatgctctgcccacatttaatttcacttctaatggcacacagggaaagtcccagcaatcgagaggagcaggactgtcctgacagcgggtcacacacagtgaaagcaatgatgccccctacagaagttcatctgaggcctggccataatcagtatattgcagagaggtcagcagtgaccgaaattttattcataagagtgccctgagacaaggtgtacattttgaaattggtcgaggtctgtttgatggtccaggagatggtctaccttcgtgaatgctgcaagacagtagagggggaaaaaacatacatgctctgtttttgttgttgggtacagtgtgttgggtacggtgttttatttatgtcatttagatcctgttactgtagtggttttcagtatctgctgattttctttccagtaattctgtcacttgcttaggaagagttgtctcttgggctgaaagcatttcgggctgggcaaaaagaaagcttgctctgggtatttcaaactgagtatttttgagggcaaggctggaggcaggagggcagcttgggaagctgttacatcggacccacctgtcattaaagctcgtactgcactggcaaagaggtatagcttgctgattgttcacagaatgcatttggggattggatttgggaggtgcgagagagcttgtctcccaggtgttggtgtggttgttagattagagaagcctgagagaaggcaagattaggaccccttccaggtgtgtggctggtgtctagtctaacccatggacacgcgcacctctgttctttataattcctgctccatttctcaggaggttcaacacagttgcttcctctcccaagattcctaccctgattgtgccacctgtgagataaggctcttgtatctggacaggcagaggagtttgttttctggggcttatgtggcgggttggcactttgctagccctaccatggagttagctcacgacgtggtacgtggtaagtggaccattgatgtgtctcaaacttgtctttttgttctcagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacagtgagtatcttggtggggtctgcattaggtggactattctggaacctgatagaaggaagaccacttaaaacaccctaagttgattatttggaggagagcttcggaatggggggaaagggagtttagggcatctatatttggcacaaaaataagaaatcatgtcagcggtcctttctttagaaatctaagctaagtagaaggttggaaagaaagaaaaaaaaaacccagctggttggttctgttctccatccttagttccacgttgtctctcccttccctcctatttcttctttttacccttagattccttacgggataaagtatgacaaggcatggctaatgaattcaatccagagccattgcagtgaccgcttcactccggttgatgtaagagaggatggtgaagccagatgagtgggcatgggggacggggagaggcctggctcagcaggggccattggcctctgacgctgttgctcttgccttcactccctgtagttccactacgtccgaaatcgggcatgcttctttgtccaggatgctagcgctgcctccgcattgaaggatgtcagttataagatttatgatgatgagaaccaaaaggtgtgtgccgagggcatgccctgtacttagtctctgggcaggaggacaggccagggggctggtcatcctctttgggattagaggtcctggtacttaccaccctgccttcctgcagatatgtatatttgtcaatcattctactgcgccctactctgtgaagaataagttgaagccaggccaaatggagatgctaaaggtaatacagactcaaggatcattgtatgtccacttcctggacccacctcttcttcccctggccccctctttccctgtcaccacaccaccaccaccaccaccatcaccagagccccagagcctctgtcttcatctctatctctgcagctgaccatgaacaaacggtacaatgtctcccagcaagctcttgatctccagaatctccgctttgacccaggtaaggctgacagcagcaattctaagacaagcgggggcagagaggtctgcctgggagggagacttaggaatggcaatttacagaggggttggggctggctctggtccagccagggccctcccagccttccgattcccttctcttggcttcttcaagacttgatgggccgtgacattgatataatcctgaatcgaagaaactgcatggctgccaccctgaagatcattgaaagaaatttccctgaggtgaagccttaggctcagtgctggtatttagttagaggggtggaagggataaggtggagggcagatttgtctctgaggcccaagatagtagccgccactctaactcttcttgacccaaagctgttgtctttgaacttgtgcaacaacaagctgtaccagctggatggcctttctgacattacagagaaggctcccaaagtcaagaccctgaatctctccaaaaataaggtgagaagggggagccagatcaactttgggtggagggcaggacacatcaggataatggcaacagccaggcagtggcacctgtgggtgactatgagggccgggggaattcagggcccagggtcctgggtgtctctctttccctggccctccttctccagtttcctccccatctttcttagctggagtcggcgtgggagttgggcaaggtgaaagggctgaagctcgaagagctatggctagaagggaacccgttgtgcagcaccttctcggaccagtccgcctatgtaaggtcagtggcaaccccggtcacccttcctgggcacctttgctccctgggtgactgagctgtgtctgaaggtgcccttctgcaggaagaagcagccttggtcctctgggaggaccacagacctcccttcctactctctctctctctctctctctcctctctctctgtcactcactcatctgtgcttagaggtctcctttccttcctctgacatggtccccttttcacctgctctggggtgtgtttcccgcctgtctccaccaagcctcctccagtgtgccctctgtgagtgtgctccaggaagtggggctcccccacctccccaggaccagcagtattcagatgctggtgccctggaccgagaagagtcctttagtccggggcttcatgctgagacaggccttcctgcctccatgctgcgatggggcttccctcccctgtcccaagaggggttctccttctcttgctccaaaaaggtccccccacctgtcctgggctggcatgggggcttccctgccccatactgagggctggggccccgggtggctgctgtcatgccatctcttcctctggcccaatgccaggagctgggccctccttggggagaaacctgggtttcctacgtcaaggggccagaagcgggccacgttcctgaggcaggagtggaaggcagagggcagaggaggttgagaagacagaaggacaggcctctcaggcactgccccaccttccctccttctccacctcacatcgtcctgcctgggccctcagaggagccctgggtagcccgagatgggtagcattcctcggtcaaggcgtcagcacagaggggcacaggagtcagggaccatcagaagagaatgcagtggtctggagagggggtccccagactctgaaccccatgctgagctggggcctgactcttcactcctcccgggagaaggtctcctgtccccgtggctgctctgtttcccatgcccagctcagactgagctcacacaggtgaggaaggctccagctgcatccagtgggccccagcccaacaggcgcatgttttcctttcctgcctcggtccccagggccagccagggagcagtgagggaaagggctgcagcaggggagcccttttctcctcttctcctccctgaactccacctccgcagtagagagtctttcccttccctttgcattgcatcctgtttctcccttgtctctcctctcctatgtctcacccatccgtccctcccctaccttcaccccgtttctgttgttgtcccccctgccttccgcttcctgcctcctgagtccggcctcactcacctccgtgtcccagcatcctgggccatccctaagggctgacctggtcttggccagggcctggtcaggcaggttgatggacagccagtgaggtggcagagccctgggctcccaccccatttcctgctccctgcagagccttccatggtgacttgggcaaaggggagggagggagaggaagaaagccctggagcctgggctcccagtgctgcttcttgtagcactggagaaaagggagtcaggacagtctagatggaagctaaccaggaggaaggagagggaggagtgtgagagggagtgggagagagactgtgcaaccctgaactgtcagtcacttcattcaatttttggttttggacagtgccatccgggattgtttccccaagttgttacgcctggtaagtatgtataataccgtcatcattgtctcctcttactcaagaaaaggacctccacgcctgccctcaagtcctttgggtcttgcctagattacatgcttgtatcagaccctcatccattttacaggcatggattcctgaaaaagacaagaatattctccctggaaaatgtgtccccccgccgccaccccccccccacacacacatttgcatgtgatagtagagatgtccagcaccccatgagaaagccacccactggaatttccagggccatttcccacctagcctctgatgcttgtctccctgggcatgttcatcttatcgatcatccagctccatctccttggtctccactgctgacttcctctttccttctccaggacggccgagagttatccgcaccagtgattgttgacattgacagctctgagacaatgaaaccctgcaaggtgaggaagaaggaccaagcaagatttgggttgctgtaagggaggctttgtccaccgcatagatccaaattgtcttttgatttcaggaaaactttactggatctgagaccctaaagcatttagtcctgcaattcctgcagcagtgagtatccctgggaccatgaggaaggggagggctgagacaggctgggccacccgtgcagcctgggagttttcaagtctcatctggggcccaggccacagagatagcctatcctcactgcttccccacaggtattactcgatctatgactctggagatcgacagggtctcctcggtgcttaccacgatgaggcctgcttctccttggctattcccttcgaccccaaggactcagccccgtgagtatcacggctcagaccctgctctggggctgtgtgtctccccagcagacacaggccaactcctggaaatgcccacactggccggaccacccactcctgctcctctttttctcctaggagcagcttgtgcaagtactttgaggatagcaggaatatgaaaacactcaaggacccctgtaagtgtgtgatggggaagagtgggcaaggtaagggggtgtgatgggaacaatcacaggggccaaggaccaggatgtggtagccccccgccctgccccgcccaccctgccattccttgcttctcctctcctctacagacctgaagggggaactgctgaggcgcacaaaacgtgacattgtggactccctcagtgcgttgcccaaaactcagcatgacctcagctccatcctggtggacgtgtggtgccagacggtgagcacctgcttcctcccttgggcaggcccagagagccagaggtgggtaggaggttaaggaggatcctgagcacctgagcgcttccttttcaggaaaggatgctctgcttttctgtcaatggggttttcaaggaaggtgagtgtctgtatagtcccctccccagatcccccactgctccctccccctggctgggctccctctcagaactcccccagcttccctgctttcgttcctttcctttccttcctcttctttcttccgtgttttcccacccccactctgccttcaaaccaccctgatctgacctaggtccatgcctgtctgccctgcacagctcaggcgtgcgttaaggacacagactgtggagtttgacagctctcatcccaggtccttactctgtgaacttgtgctggttacttaacccttcagtttcctcatttgcaaaatggggctaataatctatctcttgggctactgtgaaataggaattaagtgaacttgtggttttcccagggccccacacatgataggggccctgtcactgggagcggattgttcctgttgctgccctccccattcctgccacatccgcctgactccaagtgaacaattgtcctggtctgccccctcccccccttctgtgtgagtgtcaagcaatactctgactggggatcaccgtgtgagcatgttaaagcctgtgcaactctaaggtggtggtgtttgttgtctttgaagtggaaggacagtctcagggttctgttctcgccttcacccggaccttcattgctacccctggcagcagttccaggttagtgctgtgttgtgggtgggagcacccatccaagcttggggccagtgttgtggaaatgtggtgggtgcagtcctccgggtgttctcaatattgtggaaggccgacaggaagatccaaggagcagtctagcctagtgtttaagagtgtgggccctggagtcagaatacagattctgttcctcactccaacactcacaaactgtgtgaccttgatcaacttattcgaccactctgtgattcagtgcctttttctgaaaattggaataagactatccacttccttgggctgttgtacagggtaaatgcgttggggttggatctaaaaatctagtgaagctggtagacagtccctccaaaggtggactctgtgggagggttagagggtaccagccaaaaaatctgggaggcaggcacagttagggatatggaaggaatttggttgttgagtggcagtggttaagaaggatcctgttgttgggggtgcggagttatctacttgtccagtttgagggtgcatttttctttcctccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgagtgctgggagtacatggggatgggggctgttgggacatcagaggaatgagtaatggaaactcacatgcaatttggaaaaataactatctgggtattttgcttccaaaaaaagtgggtccatgaaaaaggtatcatacttttatactggtatatgtaaatatttttttaaatggcataatgcccaaatgacattaccttccatttgtaaaatctgaaagaatcaaccacaataaactactgataaaccaggtcagcaaggttgaaagatacaatatacaaaaatcatttgtacttctatgtagttgcaatggacaatccaaaaaaatgaaattaagaaaataagtccatctacagtagcatcgaaaagaagaaagtatgtaggaacaaaattaagagaagaagcgcaaatcttgtactctgaaatctgcaaaacattgctgaaaaaaattaaagaagacctaaatacgtggaaaggcatcccacgttcatagattggaagacttaatatcattacgatggcagtaccacccagaacaatctacagattcattgcagtccctgacagaatcccaactgacttctttgcagaaattgacaaggtaatcccaaaattcatgtggaaatgcagtggaccccaaacagccaaaaccatcttgaaagagaagaacaacgttagaagactcacacttcccgatttcagaacttgctacaaaactacattaatcaagactgtatggtaccgacataggaacagacgtgggaatcaatggaatataattgagagtccacagataatctcacgtatttatgtccagttgattatcattcagggtgctgaaaaaatccaatggagaaaaaaaatagtcttcttaacaaatggtgctgggagaagtggatatccacttgcaaaacaattaattttgacccctaactcacatcacgtgcaaacactggcagaaaatggatcaatgacctaaaataagagccagaactgtaaaacactgtaagtgtacatcttcattaccttgaattaggcaaccatttcttacatatgaaaccaaaagcacaagcaaccaaagaaaaaataggtaaattggacttcatctaaattaaaagcttttgtgcatcagcagacactatcaagaaagcggaaaaccgactggtgggaacaagggaaaatatttgcaaatcacatcgccgacaagaagaacccttacaactcaacaacaaacagacaagccaccgaattaaaaaatggggaaatgatttgaatagatgtttctccaaaggagatatacaaatgaccaagaagcacgtgaaaatcttctcaacatcgttagtcattagggaaacgcatatcgaaaccacagtgagttaccacttcatacccactacgctagctttagtccataaaaggaaacatgacaaatgtcggtgagaatgcagagaaattggaaatctcatgtattactactgggaacataaagtggagcagttgctggcaaaaagattttggcagttcctcaaaatcttaaacatggagttaccacatgatccagtaatcccactcctaagtgtataccaaaagaaatgaaaatatatgcccattcaacaacttgcacatgaatttccgtagtggcattattccaaatagccaaaaaatggaaacacatggattgaccttcagctgatgaatggataatgtggtacatccatacggtggaatattattagaatattattcatccacaaaaaaggatgtagttgtgatatatgctatgacgtggatgaaccctgaaaacattatgtgctaagtgggagcacccagtcacaaaaagccacataattatatgattccattcatacgaagtgttcagaatagccagatccgtagagaccgaaagcagagtagtggttgccaagatctggggaagagggagaacagggagtgatctctaacagttaaggagtttctttttgaggtgataaaaacagtttggaattagataggtgtgatggttgcacaatcttgtgaatagacttaaaagcactgaattgtacaccttaaaatggtgactgctacagtatgtgcattatatctcaatagaaaagaaacgtattattgaatttccacttgttatttcttgaacatctttctttatcaatatgtattaagctcccttgttcatttgaataccgctatgtttctgatttgaattctagtgggcattaatgtcagggatgggcgttttggttttccccaggccttttttcattgttacaatagtgctcatattggtacatgtgacccagcaaaaaggtagcatagattaagggtggcattgcatagtcagcgtgtctgtcctgggctagtaatggagagcacctgttcttctcccaccccaggtgccttcaggacaatgagtggaactacactagagctggccaggccttcactatgctccaggtgaggtctgggaatcaagtgggtaaaagacagctgtctctgggtcgtcaggagggccaagaagatggaggccaggtagtgtggggatggaacccagtgcacctggctctactaacatcccaactccttttctttactttctctagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 4806 - DNA, 111354 bp, human
gacgcagaggcgaggccgccagtcgaggacgaggaggaggtgagggaccagggtcgcgagggctgtgggggataccctgctgcctgagtccaggccggcagagccccttcaggaaggtctggagcagtagctaaggagttagaaggtattccaggaccaatgaaaggtagccagagccgaggaagattcctttcctagcttggtcagtaatgtgcagtgtgccccgcttctggcgagttaattgtccatctctgggccttgttttcctcttctgcttgcccaagaccagacttctttgatttcagtaaaggaagtgccactaattccccttcccctcgaggcctgtttgaagaccctagttgttcctttgagaacctttgagccctggtacttaatcctttcaactgacggcagcgggttcagtcaccaggacacacaattgtagttgaagagcgctctttctttttgtccctgggcgagagtcaggtcttacacagcttgcctcttcttttctctccaattccagataacatcaagatgccgaagactgaggaaactgtgctccagaatgatcccagtgtagcagagaatggggcccctgagcctaaaacaccagggcagagccagaaaagcaagagtttctgtttagatgaccagtctcctggtaggtctagaatcatgtcatcacttctatggacagcaattaggctaaaggaatagacagcctgtgatttaagggcctttaagggatatagaaggctcttgcaaccttgcatttttccttactaatccttctgttagtcctcttttggattattctttctcttgtctttctgccccctctaatttttacatgcaggacttaggcccctaattggtaagtaaaattaaaagattttggttttagagaaagagaccgacaaagcaagttacttgtgtttgacaacagtcgagagtgatttagtcagttcaaagcctgggaaataaatagcattcttgtattttgattttgtaaagtgcaaatggtagatctaggacagatcgaagtgatccaaattatctgttgcttcagttgtgttctgtccttttccaggggtgctttgttgacataaaaattaccactgctctggggtaaaattatttaggtctttaataatagcatttttatgtgaacattgggactttaagtctttttcacaccttatgttaggcatttgaagctttggcttgactagtccaacctcacaggaactcaaattgcagttcttttacaataatctccagtgaatttaaccaaaggttaatctgcagacctctccagatgtagcaatttgatccaacctcttgaacactgaaacggggaaaaaatatgaagttgaattacgtgtgtttctctggtggccacttggggtcactgctagtaagcagaatggcacaattcatacttcataatatctctcaaagaaatgatgtcttaatgaattaattagatggtatattttaacatatgtagctttttagttagtatagaagggaaataccagttgatggaccaacttttcaacagaagtcttatcaacggttttttaaatgaaaaataaatgggcataaatggaccatcttcttggagtgagctttaggattcttatatgtgagttttattatatcttaaggataaatcgttctctctgaccaagttatgaaactacattaaaattgagttacaaaatagttttattgcatattttattttacatatcaagtaataattgtgactactatatatactttgttttactactgaaagtactctgtatgatgaatttagaacactggttcccaaattcgaatgctgggctaggacatagttcttaccaatattgaatgaaataaaacaataaagaggttgtaatgagtttttaaaataatattaaattgattcaatttaaaagagtactcttaatgctgactgtgttttctttatactttctgaggtgttaaaatatgttttctttttatgaagtgattattttgatgatggtagggtagtttcattgtttgcttgtttgctttcatgtccatatgtggaaaaataaaaattgtcaaatcattatctgtcactcatgttgttttgaagtgttgtctgttgaatacccagatttggaaactactgttttaggagcaggtttcagctttagagccatctagtaagattcgtgtggtatctataaggagattttagccttcatcttgtgtgtagcccctgaggtaggaagagaacagtgggaacacaataacttttagatacacattaattttacaaatcacaacttattcattgtttgctgtgttttgcttatggttttacatttcaagtggaaggttttcaaaactgttttatgtttttcaaaaactaatttcttcctcccatgcctgacttctctgagatgttcagtgttactgaagagcaaagagttcagaaaacttctggtggtaaaatgattgaataagtctgtgtaagatccgtttgatgaatctaaacttgggagccttacttggcagagtgaatctctaaataaaataaaaattctctttgtgtgggttccctgttgatgatggctatgctttttttctttctttttccggaaagcagacctgatgtcttttctgtcacagatctgatagagacagttaatgaagtttccaagctgagcatttcacatgaaattgtagtaaaccaagatttctatgtggaagagaccattttgcctccaaacaggtacagattattcagtttttttccattttactcttcggggcataggtacatagcacagatgacttttggtcagacttgaagcatcttattaataaatttaatggttgagtgtgtcttatatagtaccgacaaattagtgtaagtattactttaaaagtgtcaaagcagcaaattatatttaaacaggtaataaaccaatgcagttacaggttgaacatcccaaatcggaaatccacgatgctccaaaatccaaaacattttgagcgccaacatgatgctcaaaggaaatgctcattgcggtatacaagtatgctgcaaatattccaaaatccaagaaatccgtaatctggctaggcgcagtgtctcacgactgttaagttccaacactttgggaggccgaggcaggtggattgcttgagtccaggaagtcaaggccagcctgggcaacatggcgaaaccttgtctatgcaaaaaatacaaaaattagccgggcatggtggtgcatgcctgtagtcccagctactcaggaggctgaggtgggaggatcccttgagcctgggaagcagaggttgcagtgaactgagatcgcgaacacgccactgcactccagtctgggcgacagagtgagaccctgtctcaaataataataataacaataataatccgtaatccaaaatactcccgtcccaaacatcttggaaaaggggtattcattctgtattgtcaaaatgttcatttcaggatcttagttaataatgaaacgtagagtgattttcagatcttttcagacagacttggaagaggtaactcctagccgttcaacttttaattatctgcagattaaacaggcagagatgagcagattttctaatagtggttttgttcactcttcaggagtaggaaatttcaggggacacttctgcttcataatcagtgtaataaagattctgtgaatcaagattagaaccccatcgataaatagtgtgcttctacaattaggctttatattggtttctcttaattatattgatataacaatatatgattaagaatcatccagcatttatggattgaatgcttctagtgtttattaagagttaaatgggttgatttctttgtcagaatctatattttacggtatttctaatttcccaccttaaatgcttctgttattttgccacttttgggattctgttacgtaaagccccttgctttgtcagtggttctcttgatcttcatacttcttagattttcctttgtctgttgccaaggatgggttacctgaaggaagtttttaccaaaacacaggtctcgtagcatctccctcattgcctttatagtccctgcggcccgagttagatttgtttttctcctggtaggggtgcagaaaaaagtgaagctaagagaatgaaggtctgttaaagtggctagggatctcagggggtggatagatgaagcaggaggaataatattatttagggcttggatttcactgtgttttttaaattaacaggctttttcaaatgtagtaatacaaaatgtatactggataagaggttgaaatagagtttggggttatccattatctacagataattgacagttttccctttggacttataaaattatactaagcacagttatcggtttttaggggaaatctcataataagacatttattcaacaaacatttattgagtacttattaggtggaaggcagaatgttgaaagctgaagacatatagttgagtgagtcactgtctttgccatcaaaaagcttctgtagggaagatagtcaaatagctactgtgcagagtgataagttatctcatatctagtgtgtggagttctatgcagtgctcagctacctggggaaggtcagcgaagactttcctaataaggtaacacttgaattgagtcttttcaggtggtttaggggagaagggactctcctggaagaggaaatgtcatttcagagccatagagggatggaagacaattatatattaattataagtggactgtgattgttagagcacaggatgtaggaggagaaagaaggttaaggtaggagaagtggcagaataggatcgtgaagggacttaaaggccacgtacactgctagagataggtagcgtctgaagaactttaaatgagtatactattatgatcagatttgtatcttagaaaactcattgatttttatcaaaaatatgtaccattgttggggtaaggttttgtgggtgtaaggtggccatttaatagactatagcaatagttcaggaaagagatgacagtgggtgggggccgattccagagatatttaggaagcaaaatctctggaattgggtgactgagtggataaaggacatgaggggaaaggaattaagaaggactacagtacacaccagatagataatagttgaactttcacaggttagattgttgtgttggaggagaaactttgaatttttgtttcatatattttttaatcacttgtatttttgtaaacagaaaacatacattactattatatacatacacgtatatatacacacgtgtgtgtatatatgtgtgtgtgtgtatatacatatatatatatatatatatatattttttttttttttttttttttttttttttttttttgagaccgagtctcgctctgtcaccaggctggagtgcagtggcactatttcggctcactgcaaactctgcttcccgggtttaagcaattctcctgcctcaacctccggagtagctgggactataggcacccgccaccacgcccagctaattgttgtgtttttagtagagacggggtttcaccatgttggccaggatggtctcaaactcctgacctcgtgatccgcccgcatcgacctcccaaaatgctgggattacaggcgtgagccaccgcgcccggcctactattatatttttttaaagagaaaaagtctcagatttctggttacagaactaagtatacatgaggaacaaatttaaagaaggaagataaggagttcagttttgggcttgctgaatttaaagtgtctcagaagaccttcaggtattatcaagaggtaaaatcctttcctagatttcaggcctgaaggaaaaatagcatctggttcaaagttttaagtctatggcagtggaaactaagtcacacatccaggctaggtgcagaactagggttagaagtcagagtctcaactcctagtttatggttcttcctgctgcaggaagagagtgtctctggaaccttgaggtacccttctgagagaatttagccaatgcttttccatctgagactaccttcagtttattcagcccttctcaagtctaaacataggtcctcctagcctgtcaagttaatggtctttcataattttaaatgctgtttgggaaattatgatcctgtatcaattttctaggtaaaagagcaatctgctcatttaacccttcttatagtgtagaaggcaggtttgcggaggcaatgtacaatgctttttggaaccatctgaaagaacagctattgagtactcctcctgacttcacttgtgcccttgaacttctaaaagatgttaaggaggtgagtaaccaactcccattcgtggatgggaagttcctgggcatctcagaaccttggatcgtcaatggctgttaatatatcaagtagcatactttttttaacgtgacctactacttaaatagataggatggggcagcttccattttatttgtataagatgaaacttgaccattgggcgatgactataacaatatataactcaattaaacaaattcttactgaaaccccactatggtctatgtgtttcagaatcccggagatgaataggcgagcccttgcccacaaggaacttgcatgcttgagtcaaaaggctatttcaagggaaccttaaagattccagatttgctattttatcctcacactttggagtaaaacaatctaaaaatatccttatcctttattaagaatgcctcatctccttgtggtggtgtgtatttcatatttcttatatcccacacatttaaaaccacattcttatttttattcatatttttacctcattctacctaaaaaatagtaatgactactactataactgatcccagtgaagccttgaatggtaattgtcctctagacagaaagaaataatactctctaagaaatgtagagactcagttctctgcccccccagaagacataatctgggatgcctttggcctaagagcatagttcattggagaaagtttgaggttctgaacagaacttggctcctttgatttcctttgttgggcagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggtgagagtctagatgtgctgtcccccaaatctgccttagacactgtgccggagaactctgagccagccactgtggatatagcccctgtcttatctaactcttgtgtactgatgacctgactaacacaccttttctcctttctggattattggcttttattttccaaggacagtctctcggggttccttttgatgatctttagatcagttgggtctcctttatgtcatgatactgttaagacattaagttacagtaattctttctcctatagattgcaaattgccttttcccagatgttgtcctgtttgtcccaactcagaccttgtgaggggacaggaaagaggattatccgtgtttcacagctagaagaaccaggacccggaaaagtaaaatgatctgctcaatgagttagaaattcagtcacccacatcccagctacccacatataattgttaacaccttggtgattttcctttcactgactacccttttttcaaggtgacagactgactacaggcaaaagagctctcatctggttgttaaagtgtcaggaggtataactgtccttagttttgccatcaactcactctatggccttgggtcactggccacagtaccattattcataagttgaaataggactgtttgtttttaaggcttcttctgactctcaaatactctgcttttatggctccttgcttggattccacccttccagactagatttcctttaatagtgtaaatgttctgtttctccctacggcaggggcatcctccgtgttctgggcctaatgaaaatggacatggtgaactataccatccagagctttcgaccctacctgcaggaacattccatccagtatgaacaagctaaattccaggaactccttgataaacagcccagtatgtttaaaattcaagggcaggagaggggagatttgacctcaggtctgccttcttatagcaatagaggctattttctattttttgaatagaaagtttcttccttgggcaaggggtagggagaaggaatgtttctctaagatagaaagatctacaaaatcacttctttatagaccaagagtatgtctcagagccatcatctttaagccttggaattttaagatgcatattcccttctcgtcgtaggtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagaggtagggatgtgtgtttgggcattgccttgttctatggtattcagtgcctccattcaaaccctcctcttctgatgggctgtccttcgctccctcaccagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggtaagattcatagatctctgttagagagggaaatgtgtggtatttgggacataggtaatatcaatactattattgcttattcttcatcacaaaccacacaaaggcccttggaaatgatcttcaaagattttggtatctttgataatttgtattgaggtttgggatacagaaaataaaacttattttccaaagaggagagtgtggaagccagtttgctacaaatattccttatgtgtttgctaaaaatcagtcattatatacgtgattgaatgacagtggatttgtgctatgtatatctagaagttgatcggttggtcagtgatattgaccattcactgcatgtgggggcagggatattataccaaagtacaaggaggagtaggaagtccaagcctcttaatatattagcaatttaattggtggggtaggagaaaaaccatgaaaaatatccaatagagtcttaaaacaacatttaaatacagttgatgggactggagaatgccgagtagatccaaggatggaactgaacccttgcccaatttactttgttttcatcgaagtggcatatggtgctgtgtgtttggatcaggtggtaccttgcgggtaacaatgagtgtatttcatctgcccagtggctaatgctgtcttctggtggcagagagccagaattcttcctggaataggcctggcttgtggtatgaggctctctgggctttgcccctctgccaggcccactctgcattctatcccttattatctaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggtaagaatctccatggtcgtcgtgcagaaaagtggcaagaatgtggggcatgggtgggtagaccttaccctgaatgtgagttacctaagcatttaaaaatgaaaaggcatgatcatttgggaagttttttagctttagtttcctcgtctataatgtgcactgttcaaatagatctttctcaatttggagaatgcatgtatggtttgaagacagctctgtacccaagatatgtcattcacaggtgttggatattatcacgctaaccctatgaagtcattcctggtattttctcttttcttttcttttcttttttttgagacaaagtctcactctgttgcccaagttggagtgcagtgacacgatctaggctcactgcaacctccaccttctgagttcaagcgattctactgcctcagcctcccgagtagctgggactacaggcacgcgccaccatgcctggctatttttttttgtatttttagtagagatggggtttcaccatgttggccaggctggtctcgaactcctgacctcgtgatccgcctgcctcggactcccaaagtgctgggattacatacgtgagccaccacgcccagcccattcctgggtcatattctaaatgtcggccaagatatatggaggaaccctttctctatcctatgctttaagctaccatttgggcccctacgcctctccatggaagtgatgctgagttgggctgtaggacatgttccatgctggaatggaagcagtgaacttggccagcttgctttgaactttaccatctgatcatagcctggattgggtgtatgggcctgaacttggtgcactggctgcaacatgtgttgttactttcaggtaccgggtctacggtcctcttgttaagttaaacgtgccctaggatctcacatacagctacataaagtaatcttatgaacccccagaaatttactacctcagcatcttttgatcatgcattgtcctttgggagattgatggcattccattcccccaaacaaacaaaaatctcatgtatacggtttacccaaatgagcagagaggtcagtgaataactcggttaatgcaaaactttggtgagcagatagagcaaaggcattgtgaatttcttctgtaccgtcttcgttcctcttgtcattgtttttccctgctcacagatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaagaaaatttcagttcctcctgtgttctagctgaagtcaggttctgcagcctcatcccctaactagctgagtgagaatccagtgggccctctgttttcccttcattggctgatcattcttcagtatgcttgcctgagccgaatctgggcatcaggtactgataagggaaaatcctgggactgtatagaataatgccccctgaaaactgggaaggagctaagagaccaaagaatgacccggacaagtccggcttgataagcagatgaatttcttgggacttacgtatagggcattcctgggtggcagcaggacagctctggggatctgccctgacactcctctgcaagctgcttttaagctaattttctggctctttgccttctgtatgcaatgagactctttctcttggtatgtttcccagtacactctgggatgttttggttctcacagacacctcggctcctaagctgggcaccatgcatggccttagaccaccacctggccttcagggttcaggcagcagacatacagccttaagtaatctggtgggggaggggggaactcattaacctacagtcactagcattattttctccattgaaaaatcatttccttgagggctttgaaaactctttgtgagattatccagagaatgactataagggcttctggaagtcagaaattcactgaattgcagatgaagagaagacatagaactccatttctagcaccacatttccctgtagttttcaaggatacagcaatagcaagagttgcgaactcccgttctagtgtctggtttgaagcagtatgaaaactggggattggttgaaagttgatatggtgaatatcaactttgtgccaacaggcattcagctaaggacaggtctcagcttccaagggatttctttcttttaagtgattctaggggtcaggcttggaatctctgataatgacagtaaaccgaagcaattaggtcagtgagtatcatatcaagttcaccccgatcctatttctacagctgaattaatcttatctggccacatctctaggcttagaacatctccttcttcttgacagaatcgatgtgcgtattcaagcgtggggcagctgccatgctttttcccactcctagtctgggactccaactgccaagttatgaatatcagctgacttggcaacacaaatgatagatgttcttggtccacaaggacttgggcttgttgttagagactgcagaggttcgtcccatcgttcccaggccaactgcagcagacaagcagcaatctagaaaattaggaacaaatttaggtttggatttggactaggtttggattcagaatggacaggggacaatagaaacttacttatgggatagacccaaactggttgaaaaaaatcatgtcctcattatttcggcggatggaaggagctgagtacaatttactcagcccaagaaaaacaacagatgagattggagttccattactccccagggaaccacgtgattgatttccctagagggtggataccagatgggtgacatagctgggtaaacagagtgctacttttactttggctggagatgaggcacacagaaaagctgtggaatggatcattcacgtgttctaatcttgtgactagatagtctcaggacagagaccatggcagatgaatgttttataattaataaataggcagtgagcctggcctagttaaattttctaatgtgattagacaatacgaatacaattttttaaaaaagtattaattttgggagccagattatcttacagacaagtgtgttctgaagtgatccctgtgaagatgacggagtagttgacggatactgactttgggctgcaatgaaactttgctttatactttataattaaaatctgacttgtgttgatttcttggagattttgagtttattgattctcttgtgcttctacgtggaggaaatgggaatcctgatcctaaacaaggaaagatagctcactcaattctgttcaccatttagggatggatggatgcacagttagatagataggtggaacatgcacatggttaaaaatgacatgcagtacagagaaaattcggttttttcgccacccctgtatctcatttatcctacttagaggaaactatatccaggtttttgtgcatacttctaaagatattctgtgcatatgcaagtacatattataattataacaaatatttgtgagtgtgtatgcaccaggcactcttttaagcactctacatatattatttcaattattccttaacaatttatctccagtctacttttccaattctagaacaatgttgtacagaaagctctaactgagggtaagaaccggtgtttgtttgtttgtttatatatttatttatctggtcttctttgagtgagtaagggaaaatcatttcactttcttgggctttgtcttcatctataaaattctatacttgactaaattactgattttcttgttcaattttatagagtcatttttcacaaaacgaaatctttccagaagatcacgaataagagagatcaaagctaggcagcttgagttgaagtagagctggaagaaggagttttgaggactgtttcaaaaccactggactagatgatctctaaaggttcctgtattattttcttcttttcttatggctgttgtaacaaattaccccctgaactttgtggcttaaaataacatgcatgtattctcttatcatcctgattgtcagaagaccaaaatcagtttcagtgggtgaaaatcagggagtcagtagggccaggctccctctggaagctctaagggagaatccattgccttgccatttttagcttctgaagctgtattctttattccttggcaaggcaatggattcttccctggagcttccagagctcccattcctttatcatcgaagccagcatcatagcttcttgtgtcagtcatcacattgcctccttctatgtgaaatgtccctctccttccctcttaataaggaaacgctcttacatttagggccaggcaggataatctccccacctcaagatccttagtcacatttgtaaagtcccttttgccatataaggtggcagtcaggggttccagagactacaacatggatatctttggaggccattatttagcttaccacagcctaccctctaactccccaaaattcatgttcattctacatgcaaaatatatttgcctcacctcaatatccccaaaagtcttaacaccaacgcgagttgaaaatctcatctgtaaatcatctaaaccaggtatgagacagactctgggtatgatccttcttgaggctaaatttcttttcatcagtggccctgcgaactagaaaataaagttacctcttttttattacagtggtgacatggacataggataatggttatagacagtccccctcccaacgggaaaaaatgaaagcaagcaaaaagttaccagctccaagccaacttgaaatccaatcaggtaaactcatttaggtttcaaggcctgggaatattcctccgtggctagaggctctgccctctatgcccgaggctccaccctttaagtgaacagagccaggctctgtcctcagagttatcttgtttttgtttttgttttgaagagtaatacatgtttgcagcagaatactttattattattactattattatactttaagttttagggtacatgtggacaatgtgcaggttagttacacatgcatacatgtgccatgctggtgtgctgcacccattaactcgtcacttagcattaggtatatctcctacagctacccctcccccctttccccaccccacaacagtccccagagtgtgatgttccccttcctgtgtccatgtgttctcattgttcaattcccacctatgagcgagaatatgcggtgtttggttttttgttcttgcgatagtttactgagaatgatgatttccgatttcatccatgtccctacaaaggacatgaactcatccttttttatgactgcatagtattctatggtgtatatgtgccacattttcttaatccagtctatcattgttggacgtttgggttggttccaagtctttgctattgtgaatagtgccgcaataaacatacgtgtgcatgtgtctttatagcagcatgatttataatcttttgggtatatacccagtaatgggatggctgagtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgttttttggctgcataaatgtcttcctttgagaagtgcctgttcatgtccttcgcccactttttgatgggatcgtttgtttttttcttgtaaatttgtttgagttcattgtagattctggatattagccctttgtcagatgagtaggttgcgaaaattttctcccattttgtaggttgcctgttcactctgatggtggtttcttttgctgtgcagaagctctttagtttgattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctgcatagggctagccagttttcccagcaccatttattaaatagggaatcctttccccatttcttgtttttgtcaggtttgtcaaacatcagatggttgtagatatgtggcattatttctgagggctctgtttggttccattcgtctatatcccttttttggtaccggtaccatgctgttttggttactgtagccttgtagtatagtttgaagtcaggtagagtgatgcctccagctttgttcttttggcttaggactgacgtggcaatgcgggctcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagcagtttgtagttctccttgaagaggtccttcacgtcccttgtaagttggattcccaggtattttattctctttgaagcaattgtgaatgggagttcactcatgatttggctctctgtttgtctgttattggtgtataagaatgcttgtgatatttgcacattgattttgtatcctgagactttgctgaagttgcttctcagtttaaggagattttgggctgagacgatggggttttctagatatacaatcatgtcatctgcaaacagggacaatttgacttcctcttttcctaattgaataccctttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcttgaagggttgttgaattttgtcaaaggccttttctgcatctattgagataatcatggggtttttgtctttggctctgtttatatgctggattacgtttattgatttgtgtatgttgaaccagccttgcatcccagggatgaagcccacttgatcatggtggataagctttttgatgtgttgctggattcggtttgccagtattttattgaggatttttgcatcaatgttcatcaaggatattggtctaaaactctcttttttggctgtgtctctgcccggctttggtatcaggatgatgctgtcctcataaaatgaactagggaggattccctctttttctattgattgggatagtttcagaaggaatggtaccagctcctccttctacctctggtagaattcggctgtgaatccatctggtcctggactttttttggttggtaagctattgattactgcctcaatttcagagcctgttattggtctattcagagattcaacttcttcccggtttagtcttgggagggtgtatgtgtcgaggaatttatccatttcttctagatttactagtttatttgtgtagaggtgtttatagtattctctgatggtagtttgtatttctgtgggatcggtggtgatatcccctttgtcattttttattgcttctatttgattcttctctcttttcttctttattagtcttgctagcggtctatcaattttgttgatcctttcaaaaaaacagctcctggattcattgattttttgaagggtttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaattcgcctctacacactgctttgaatgtgtcccagagattctggtatgttgtgtctttgttctcattggtttcaaagaacatctctatttctgccttcatttcgttatgtacccagtagtcattcaggagcaggttgttcagtttccacgtagttgaacggttttgagtgagtttcttaatcctgagttctagtttgattgcactgtggtctgagagacagtttgttagaatttccgttcctttgcgtttgctgaggagtgctttacttccaactgtgtggtcaattttggaataggtgtggtgtggtgctgagaagaatgtatattctgttgatttggggtggagagttctgtagatgtctgttaggtccacttggtgcagagctgaattcagttcctggatatccttgtgaactttctgtcttgttgatctgtctaatgttgacagtggggtgttaaagtctcccattattattgtgtgggagtctaattctctttgtaggtcactcaggacttgctttatgaatctgggtgctcctgtattgggtgcatatatatttaggatagttagttcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctatatccagtttgccagtctgtgccttttagttggagcatttagcccatttacgtttaaggttagtattgttatgtgtgaatgtgatcctgtcattatgatgttagctggttattttgctcgtcagttgatgcagtttcttcctagcctggatggtctttacaatttggcatgtttttgcagtggctggtaccggttgttcctttccatgtttagtgcttccttcaggagctcttttagggcaggcctggtgctcacaaaatctctcagcatttggttgtctgtaaagtattttatttctccttcacttatgaagcttagtttggctggatatgacattctgggttgaaaattcttttctttaagaatgttgaatattggctcccactctcttctggcttgtagagtttctgccgggagatccgctgttagtctgatgggcttccctttgtgggtaacccgacctttctctctggctgcccttaacattttttccttcatttcaacgttggtgaatctgacaattatgtgtcttggagttgctcttctctaggaatatctttgtggcattctctgtatttcctgaatttgaatgttggtctgccttgctagattggggaagttctcctggataagtcctgcagagtgttttccaacttgtttccattctccccgtcactttcaggtgcaccaatcagatgtagatttggtcttttcacatagtcccatgtttcttggaggctttgttcgtttcttttttttcttttttctctaaacttctcttcacgcttcatatgattcatttcatcttccattgctgataccctttcttccagttgattgcatcggttactgagccttgtgcattcgttacgtagttctcgtgccatggttttcagctccatcaggtcctttaaggacttctctgcattgattattctagttatccattcgtctaattttttttcaaagtttctaacttctttgccagtggtttgaacttcctcctgcagctcggagtagtttgatcatctgaagccttcctctctcaactcatcaaagtcattctccgtccagctttgttctgttgctggtgaggagctgcgttcctttggaggaggagaggcactctgatttttcgagtttccagtttttctgctctgttttttccccatctttgtggttttatctacctttggtctttgatgatggtgacgtacagatgggtttttggtgtggatgtcctttctgtttgttagttttccttctaacagccaggaccctcagctgcaggtgtgttggagtctactggaggtccactccaaaccctgtttgcctgggtatcagcagcagtggctgcagaacagcagatattggtgaactgcagatgctgctgcctgatcgtacctctggaagttttgtgtcagaggagtacctggccgtgtgaggtgtcagtccgccccgactggggggtgcctcccagttaggctactcgggggtcagggacccacttgaggaggcagtctgcctgttctcaggtctccagctgcgtgccgggagaaccactactctcttcaaagctgtcagacggggacatttaagactgcagaagttattgctgtcttttgtttgtctgtgccctgcccccagaggtggagcctacagaggcaggcaggcctcctggagctctggtgggctccccccaagtcgagcttcctggccgctttgtttacctactcaagcctgagcaatggcgggcacccctcccccagcctcgctgccgccttgcagtttgatctcagactgctgtgctagcaatgagtgaggctccgtgggcataggaccctctgagccaggtgcgggatataatctcctggtgtgctgtttgtgaagcctgttggaaaagtgcagtattagggtgggagtgaccctattttccaggtgccctctgtcacccctttctttgactaggaaagggaattccctgaccccttgcacttcccgggtgaggcgatgcctctccctgctttggctcatgcacggtgcactgcacccactgtcctgcacccactgtccgacactcccctgtgagatgaacccggtacctcagttggaaatgcagaaatcacccgccttctgcgtcgctcacgctgggaggtgtagactggagctgttcctattcggccatcttggctccacccagtttttaatatttaacttcaccactgagtcagaactgaaacagttggtacggaggcctgtgttagtgagactttggcttgccacaaaaccaccctaattgaagaaatgaaaatctgatgtccaagtaagtaatgaagccaatttgaataaagttatttatgtgattgcaaattttaaaaagaacctacgaacgaatacttaaaaaaaaatttaaggtagtgctgtgctttgaatatgtccttcaaagttcatgtgttggatactcaattgctgttgtaacaatgttgagagttaggacctttcagaacagattaggtcatgagggctctgcctcatgaatggattaatgctgttattgtgagactgtgttagttatcatggcagtgggctcctgataaaaggctaagtccaaaccccattttctctttgtctcacacactctatcaccatgtgacaccttcaatgtaccctgccagatactggtgccatgctcttgagacttcccagccgccagaacagtgagccaaataaaattgtcttctttataaattgcctagcctgtgcattctgttatagcagtagaaaacagactatggcaggtaggtagacatattacccaaagagaaacacatctgaaaaatatacaccaatctttttacattgaatatgtatgcatcacagtgatgggatcatatagatggaagatgtagaatgatttcatcttctaaatatacatttataatgtttagtattttttaattaggaaaatttcttgagagaaacacttgaaaatatgtaacagcaaattaacaagaaaacacataaatatttttattttaagaagcgttcatgctatgctgtttttttttaaaagaaagattataataactcttgacttgagagttacccctatctgtgtaggtgtgtgatttgtatattacagttccatcatttagaatgttcaaactctcaatgtgcagacttatcttctgctctctcaggggttggatgtcctctctcagggcatagagacacaataagggattgctgttaagggatggacaattatagaaatttctggttgatgcactgcatatcagtcccttttatcactcccttccccttgcaagctgatctgtcctgagacttttggggttataagtctgactctgacaaacaaatagcatctttgtacattcaatactttaaaaggaaaaggtgtgattctttttttctactcccattccagtggccactaaattatctttcctatttcctttatactttccatgtctgtctctaatatgccctctctgagatggactgcactttttttttctgtcattcagttattttcagatatttttgataactttgtccttccttaagaatatgtgatgcgcaagagtttattaaaactatgtgtggtgaaatcatgcccatccagtagagctcagttctaatgctggcaatttcatgtagcatctgaatgaaccctgacaagcttctacaactcattaagtctcagcaacctaagacaggccaagaagctggtaattctgcctaccagaatcccgttatgaggaacacatggaggaagaaaatgtaatgtaatgcagcaagcacagagcatggcatgcagcaggccctcagagttcccccatgtccgtagctacgagtacctgggttccgggtctcccgactatagttagcttgctctgcaggggtgactcaattggaaacagctccctgggtgttggtggcaaactcagggggcactaagaacaggaagtagagtctcttctggctcccagggctctcctcactatgcccttcgggaaaggacttattttgaaaactccaccttgctcacgtgagcctgacaaaatggtctgaggcctactcttgcctcgtttgacagatcccctcaattttctctgaaccccagctccagatctcacagattctcctcacaaacaccatgtgaagacagtggtgacaggtcactacccacatgccacaccatgggtgaattggtcagtgccaatccttggcctcaggatctcacagggcatgaagggttctgggccccctctcccactccaacccccaggacacccagcagactcactttcagttagagctggtaggtggcaagggcccaggctgagtgttttccattgtcctgaggatgagggcaaagtgaaccctgagatacctgtcttagtccattttgtgctgttataagagaacactcaacactgggtgtgttagtctgttctcacactgctgtaaaaatactgcctgagactcggtaatttataaacagaaaaggttcaattgactcacagttccacatggctggggagggctcaggaaacttacaatcatgggagaaggcgaaggggaagcaaggcttgtctttcatgatggcaggcgagagagagagcgaggaagcgccacactttaaaaccatcagctctcgcgggaactccatcactatcgtgagaacagcacggggaaaaccgcccccatgatccagtcacctcccaccaggtccctccctccacacgtgaggattacaattcaacatgagacttgggtggggacacagagccaaactgtatcactgggtggtttataaagaacagcaatttgtatcttacagttctggaggctgggaagtgcaaggtgggggggcttgcatctgatgagagccttcttgctgtgtcatccaatggcagaaggtgggagggctagagtgcacaagagagagaaagcaagagatcaaactcatagactcaagcccttttataattggtattaatccattcctcaaggtgcaaccctcatatgacctaaacacctcccattaggagggagggttgcactggggattaagtttccaacacatgcttttttggggacacattcaaaccaaccattgcatcctgcccctggccccccaaatttatgtccttctcacatgcaaaatacattaattccatcccagtagccccaaagtcttaactcactccagcacccaaagtccagagtctcatctaaattagagatgggtgagactcaaggcaggatccagactgaggaaaatttcctctagctctgagtctgtgaaatcaaaacaagttgtctattcccaaaatacagtggcgggacaggcgtaggatagacattctcattccaagagggagagacaggcaacagaaaaggcataactgatcctaagaaagtccaaaacccatcagagcaaacaacattaaattttgaggcttgagaataatgttcaagttctgccttctgaggcagggattgggcccccagattctcaggcagccatgcctctatggctttgctaggctcagtccacccagcagctctcacaggttggagtcttgttcctccagctctcccagggtatcattaaatgccagtagctctgaaattctggaatcttagtagcagtccagctcccacacctctactagacattacccgaattgggactctctgcaactgacttgttcccacagccccatcaggtactggcctgatggggactctctctggcagctctgcccctgtggcaggtctctacatgggtcctcaggctgtctgcaacattctgcgaaatctaggtggaggccgtcacagacccatagctcgtgaatgctgtgcacctgcagaatcagcaccatttggatgccgccaaggtccaccgcttgagccttccagaccggcagcctgttcagcacccggccccccttgaactatggctgggacagccgaggagtgctgcacgaaggtgcgggcagcagacacttaaaagcatcacggggcagcagatgttgaggtcccgtgggcgtctctctggaaactttgccttcgcattgtgcactgggcatgtgactggaggagcagcctggaaaactctgaaatgccgtcagggcctttctccagtggtctttgtcttactgaatagcacctgtttcccttctagccatggtaatctcattagcaaagtggtcacttggccatgtctgtagtttgcactcctaaacacgctttttcattctttacatggctagggtgaaatttttcaacatatttaccttcttcctatcttttaattgacaaattccatctttaaagcatttctctcttctctcatttttgtctaagtggccgaacaaagtcacgcagtaccttgaatgttttgctgtttagttatttttactgccagatatcctagttcattaccctgaagttcttttaatttttttcatttttccatttttgtgggtacatagtaggtgtatatatttatggggtatatgagatatgttggaacaggcatgcggtgtgtactaatcacatcacatcccctcaagcatttgtcatgtgtgttacaaacaatctgtatcctcttaggtactttaaaatgtacaattcaactattactgactttaggcaacatgctgtgatatcccaccttattcattctttctgtatttttttgcatccattaaccatccccacctaccccctgcctccacactacccttcccagcctctggtaaccatccttctactctctatgtccacgagatcaatcgttttgattctcaggtcctacaaatcagtgagaacatgcgatgtttgtctatctgtgcctggcttatttcactcaacataaagatctccaattctatccacgttgttgcagatgactggatctcattctttttacgactgaatagtactccattgggtatatgtagcacattttctttatccactcatctgttgatggacacttaggttgcttccacatgttgctattgtaaacagtgctgcaacaaacaggagtgcagatatctcttccatatgctgatttcctttcttttgggtatatacttggcagttggattggtggatcatgtggtagctcaaattttagttttctgaggaacctgcagagtgttctccataatcgttgtactaatttcattcccaccaacagtgtacgagggttcccttttctccacaccctcatcagcatttgttattgcctgtcttttggatataagccattttaactggggtgagaagatatctcattgtggctctaaagatcagtgatattgagcacctcttcatctgcctgtttgccatttgtacgtcttcttttgagaaatgtgtattcaaatcttttgcccattctctaaccggattattagattttctccaatagagttgtttgagctccttgtatattttactggttattaatcccttctcagatgggtagcttgcaaatattttttcccattttgtgggttgtgtcttcactttagtggttgtttcctttgctgtgcagaagctttttaactagtcatgcatgatcccatttgtccatttttgctttggatgccagtgcttctcgggtattactcgagaaatttttgcccagaacagtatcctggagcgtttccccggtgttttcttgtagaagtttcataggctgacatctcagatttacgtctttaatccattctgatttgatttttatataagatgagagataagggtcaagtttcattcttctccatagggatacccagttttcccagcaccagcgccatttattgaagagactgtcctttttccagtgtatgttcttggcacctttgtcaaaaatgagttcactgtaggtgtgtggatttgttcctgggttgcctattctgtcccattggtctatgggtctgttttaatgtcagtaccttgctgatttggttactatagctctgtagtataatttgaagtcaggtaatgtgattcctccagtgttgttcgtttttgctcaggatagctttggctattctgggccttttgtggtactatatgcattttaggattgcttttcctatttctgtaaagaatgtcactggtgtttttgtagggattgcatcaaatctgtggattgctttgggtatgatggacatttaaacaatattgattcttccaacgcatgaacatggaataactttccattattgtgtcctcttcgatttatttcatgaatgtcttccagttttcattgtggagatctttcacttctttggttaattccgaggtatttaattttatttgtgtctactgtaagtgagattaattttgatttctttttcagggtgttcactattggcatatataaatgctagtgatttttgtaggttgattttgtatcctgcaactttactaaattggttgatcagttctaatagttttctggtggagtcttaaggtttttctaaatataagatcgtatcatcagcaaacaaaggtaatttggcttcttcctttccagtgtggatgctctttacttctttctcttacctgattgcttgagcaaagacttcccgtactatgttgaataacagtggtgaatgtgggcatccttgtcatgttccagatcttagaggaaaggctttcactttttccccattcagtatgatactagctgtcagtctgttgtatatgacttttattatgttgaggtatgttccttccatacccagtttgttgaggaattttatcaggaaggaatgttggatttttatcaaatgctttttcagcatcagttgaaataatcatatggtttttatctttcattctgttgatgtgatgtgtcacattgattgagttgcatatgttgaaccatcctcgcatcccagggataaatcccacttggtcatgatgaacgatctttctgatgtattgttgagttgggtttgctagtatttagtggaggatttttgcatcgatattcatcagagatattggcctgtattaagaagtcactgtaagaagatgcctgagagtggatacttggtcagtgtaatgattttaatatgcgccttttctattcttcagaaaatagtctcctttcttatttactttagaatgtcatgacccccaacctatggaattaattaaacaagaaacatttccaatacactatttcacattcagaaggtttcacagtctttcagtgtcaaaccttgtgagcaaagccagggcaacaggctctaagctgacaaaaaagtttaccagtatcttccatagagatggccttttcattcatatagattccatcggcaagtcaggccagacctttcagactctgacttgtaaaaaagtcttgtgtaaggaaaacttaccagtttgcaactagtgtttggtcactgctgagagaaacaaatattaaaaaataaataaatatgtctcagagagttaaataggcatacttggaaacacgaaagcttggaaaatgaatttaatatggcagattttattgagaatgcatcatgagtcataggagttcagaaatcaggaagttcaggaagaagaaaaagatcacaaaggcaagtttatgattacacctactaatcgaggaactgcttgctctgcaaccagtagatgatcacgagatggtcagatcttggtaggcccacaagagatgtcaaaataaaattctcaaaaataaacatcctagagacctccagttctggccaagctggagtttgccctttcctcccagatggtccctctacatcagaacaccctgaatataacagcaaaccagcaaagaaagctctgaaacgtggaaaggggaaagcagaccgactcatgctctcaggactcgagcaagaacacaggcagcgcattcccttggtttttctatttccacccaatatcccagacagggcaccgcagaagcccccagtccagaaccaccaacaatggcagacacaaagctccaagaaaagcctatttcctctgccaaaagaccataaaaaacgtgatctaaaaactgaaaaacctttgtgacaaattcccctcccctacactagacaaacaacaatggaaaaaccttatctcccccaccccccaaggtttcagggaacaagaaggaaacttgtcttctatcctgcctctctgaggcagatggtgatgatccaattcacctgtcagggtagtgtcagtggtgtccagcagcaagatgagccttcaccttcacctgacatcaataacactgaacaaggcagtccaagttgggactagtaagcattccatttatccccatctctggtgtcagtgatgcccagtggaaagttgaacctttacactcatccaaactcaatgaagtggtgtgaggcggggctaatcgacactctgctttcccgctcaggcattctgtgcaagctaggccctatggagagctgtgcctcctcatccacccatcatcaagatggaatcaggtggtgggaggcagggtttgttggcagtctcctttccccctccttcccctgatgttctcagagaccagtggggacctaggcttctgccccaccacactgcagcaacaaaactttgagtcagccatccagttcccctttccctaaagcctagcaaagaactgtgcctatactccccgaccccacctctgaggtaacaaagtgtggtgaattggtgcccccttttttattggaaatgttctcaggggggctagggtagaagttcagctcccacccccagccatctgtgaagaggcaaggtgaaccagcaatctagtttgctaggatggtatcagaacaggaatctgcacttatcaccttatgatatgatgggaccaccatcatatatgtggtctatcattgaacaaaaagtcattatgtggtgcatgactgaatatggactatcttaatgaaatgtcatcacagccttatgaggttaaattttttactattcccagtttaaagatggataataaaagcttggaagagtttacctggccaaggttatttagctacaaagtggtaatgccacggattcaatcctaagatacctgatgcccattaccccatctactgaaagatgacactgtactgcaaaaattaaaacagacatagctgatctgcttctttacctgtaattagagtaaaagaaaacaacaaaagaaaacaaaaacaacacagtgacatgctaactgtcatgaagaaaagtaccacatgtctgataaggtgatcagagatgtacactaagtaaggaaggtagctatagggatatctaaagccaggctgttacagaaaaacactcaacggtatgggagtatgcttgctgagctagtgttagagcaacaaaaaggaggctagtgtggctggagaaaaatccatttattcattcaaagtatccactgaagcaggcattgttataggcacttagggtacattaatgagcaatagacaaagatatttgcccttctggaatttttatttttccaccatgggagacagacaataaaaaacaaaaacagcatatgattaaaatatattgcattccagaagatgactgcgggggggaaaaatcaaatagggaagaagtggaatcaggagtgtgggctgagggttggacattcaaacaaatattggctgctttgcaattgatagtattattagatgggtggaagtcttctcctttgtgccgcctttgccaggcatcagtgtaaatgctctgttggcttcactgcagaggacaacacatttttcctatctttggtcaggactcagttccttctttaatatatcagagaaccagagacactaatatctgacagccttttgccatcaagtggccatgcgttttttaagtaagcatcccctgctacacgtccactaaatttgagcttttaactgtctgtgttgagacgtggcctggtagaaaccctcgctggggccaggcgcggtggctcacgcctgtaatcccagcactttgtgaggccgagtcgggcggattacgaggtcaagagagggacaccatcctggctaacatggtaaaaccccgtctccactgaaaatagaaaaaccagccgggcgtggtggcaggtgcctgtaatgccagctactcgggaggctgaggtaggagaattgcttgaacccgggaggcagaggttgcatgagatgggatcccgccagtgcactccagcctgggcaacagagcgagacgccgtctcaaaaaaaaaaaaaaaaaaaaaaaaaaaaagaaaagaaaagaaaagaaaaaaaaagaaagaaagaaagcaaagaaaccctggctggccagtgcccaggccatacacaatggcattgtgcctcacttttcacctaagacgaaatcagcgggtggggcaggcttataatcagaacacccctccctttccacctcacacactcccacccgcctgtcccacaatccttcctgcccctcccgctctcccacccttggtttctcgaaaccccttctccttccctgccccccgtcccccgagccccaggagggggaggggcaggaatctggctccgcctcccagtatggagatgattggtcaaaggaggtcacctgaccaagctgagccaattgaagtcctctccccactgctttgagaaggaaccgttaagacgctgggccccacccacaagattgcgtcttgtttgtggcaagattctgaggggaagtgtagctcccaggttggttccaagtcttcttccaattaggtaaattacaacaatatcttttccataaatttcctttcttttcttttttgcctttttttttttttttttttttttttgagacggagtttggctcttgttgcccaggctggggcgtaatgtcgcgatctcggctcaccacaacccccacctcccgggttcaagcgattctcctgcctcactcccaagtacctgggattacaggcatgcgccatcatgccaggctaatttttgtatttttagtagagagggggtttctccatattggttaggctggtctccaactcccgacctcaggggatccaccgcctcggccttccaaagtgctgggattacaggcgtgagcgtccgtgcccggcccttctataaattttatataaactaggccttttttggcctacattacctagggtcaaggtttagggattcataggaaaggcaaatccggctggattgctcagtggtccactctccagtccactctctatgtatcccttatcttcacgtgtgattaggttcaattgtatggctaatcacttcatgttctctctttgcaatttctcaggcaggttttctcttcttcttcagaaagttatatttctcttttgcatcttagttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagccactgattttgtcttttaaaattctttactctgaaataattttagacttacagaaaagttacaaaaatgattatacagagagccctcgcctggatttccttaatgttaacatcttatataaccatagaaaaattaccaaaactaactactacattacattgatgcactaattgacattactacatcgatgttaattaccaacagttagcattgatgtagtactattaactaatctacagattttatgtgaatttcaccagatatctcactgatgtcctttttctattctaggatcttatccaggacgcttcattgcatttggtcttcatttctccttagtctcctccaggctgacatttcctcaatctttattggtcttccacagccctgacacttttggagataccagtcaggtattttgtggaatgtctctcaatttgtgtttgtctcatgttttcttatgattagattgaagttgtgcatttgtagcaagcacacctgttttattctcctccctttcccagtggcgagggagggattcccaccctagtgttatgggggcggctgaacacatggtaccctatactggacagacggaatccacagcaatttatcagtaacatttactcacaactggagagaggagggcacctcacgccaggtagagccacacagtgtcacactctggaagagagtgaacaagcaggggctttcagggggaagtctttgtagtaaccagaggatgaagtgaccgttggttcagggtaggacgattggcttgtttgaataattctgcaggctggtggggacctgaaacatgctacccagagataagcaggcactgtgtctgttcaacatgataataaggagggtactttggccagggggcctttctccctgggaacccaatagggaagataacttgtggtgaggccattcagggtcctcctgttctaccccagatgtcaaggcatccatataattggacctctaattttaggtcttatgcgacattaccgcaaacgtgatttcgttcccttctatgtggatcatgtcaggggtacatgacatccataagttgtattactggtggtgctcaccttgatcacttggttaaagtggtgggagttatgctgccccagtgtaatgctactattttcctctttgttagtaataaatatagtgtgaaaagttctttaagaagaaacacaatagatcctcttatattcctgtttcttcgcagactttgacccactactgttaaaatctgtctagggatcttgcctacagcaaatattacctaatggtgattttctgttttcctaatttctgctacatttattaattggaattcctctgtaaggaagagctatctttactccctcattcatttatttcttcaatttatttatctcagtatgggctcttgaataattatgttatacatgccaggcttaatacctaggtgatgggttgatgggtgcagcaaaccaccagggcgcaggtttacctatgtaatgaacctgcacatcctgcgcatgtatcctggaacttgcaataaaataaaataaaaatttaatctaattatatcattattttgttctttgaactgttctagccttggccattgggaagtcattttggttggttctgtggtcttttgatatgaccctatccttttttggtacctttttctggcacaataagatgttcagattcagcatgtgtgtgcccccctcccctcacacacacacaccccttatagccctggattaaaacaacttctacgaggagccccggttccctttcttggggaatgatatttaccaaccagtatctcggtgtgtgttcattattaatggcgtttcattgctgctaaggctctctctatggagagggttaggaaataatgtatgtatacacccatgcctatagacacatccacatttattttggtatctatctgtatgcatagctattaaaagccaggagcttgtattgatactttcaattccaatcattctagacttatttgtagattcgttctccgacctggctttcattatcaaatagtttacatacctgtttatttctggtcagtagatacataaagtagcgcctgaattgctaacaaatgcccctgttgcaaacatattaataacttatatttttgtacagttgtttttgtctttggccttagaggatatagtcaaaatactgctctccaaagttatgtatcttagatcttttcttcctctctccttcagcgtggttaagacactcatttgtaatattgttagttgaacctgtttctgtttgatttggggtaccctcaccccaatatcccggttgattttaattttttatttatattttgggtatgtgcatcattactatgatccaaagagtcagggttatacaaaaacctatactcggagaaatgtcactccttcgtcatcccttctaccctgttcccattccccatttctttccacttctttccctggccctccctgtagggtaatcagcccctttggtttctggtttaacctttcctgtatttattttgcccaaatgagcagatacatacatgttttctcatattcctttcttacacgaaggatagcatactatacatgttcctttgcactttgcctttcctacttaacagcattcttggaaatcactccatattgtttcacagagatcttcatcgttcgtttttacagctgcattgtactccattgtgtggctgcgccacacatagtttattcaaccactcgcctatgtttgggcattttgtttttaatacagaaaccaggtctcgctctataacccaggctgactgaagtgcagtggcacaatcatagctcatggtaacctcaaactcctgggctcaagcaattcacaactgcctcagcctcccaagtggctaggactacaggtgtgtgccaccatgcctggctaattaaagactttttattttttattttattttttgtcgatatggggcctcgctatgttgcccagactggtctggatctcctggcctccagtgatcctcccgccttggtctccaaagtgctgagattacaggcatgagccatggtgcctggcctgtatgggcttttaaattccttccaagattttgcagttacagacattactcccgcgaataaccctggacatgattttttttttttttttgtattggtagaaatgtaccttcaaggtatattcccactggtaggattattgggccaaaagttaagtgcacatgtagttttcttaggtgtttccaagtttctctccagaaggattgtactggttttcatttccattagcaatatatgagaatgacaatttccccacagcctcactaacagaacatgttgccttacttttgaaacttttttctacgggttaggcgagaaatggtgtctcgctgtttctgtaatatacctttgtctaactatgagcaagttttgacacttaaccatatatttgaggactgtttttatactttttgttggaattatctgttcatatctttcccccatatttctattgctgttgtggtccttcatccctcaatatttaagagctctctatatatttggaatattatccagttgtctgcgatatgtgctgcaagtactttacatcaatttgtcagttgccttttgatttatttatgatgcatttgcatcactttcgtttatccttatgtggtcaaatggattgattatttttttctttcattgcctccggaatttgaatcctagttagaaagcttttccctacagtggggttctgccatgttttgttttgttttgttttgttttttctttcttttctttggttgacatggagtctcgctttgtcgtccaggctggagtgcagtggcgcgatctcggctcactgcaacctctgcctcccaggttcaagcaattctcctgtctcagcctctcgagtagctgggattacagccgcccgccacctcgcctggctcattttcgtatttttagtagagacggggtttcaccattttggccaggctggtctcaaactccggacctcaggcgatccacccgcttcagcctcccaaagtgctgggattataggcgtgagccacccccctcccccggccactgccatgttttcttcaagaacttacatggtttcatttgttatgtttagatccctaacccatttgcagtttattcttgtgcatgctgtgttatatggatctacctttatttttccagacgtctcagttgttccaggaccatttattaaatgtccatctttgccctaaagagtttatgtgccatctttatcatgtactaactgtcatatgatttggttgtatttctgagttttctattctagtccactgggctattagtctattcttgcaccagtgccacaatgtcgtaattacagaggctttatagtgtgcttttctggctgatatcataagtcccctctcatagattttctttttcacgtgtttcctggctatgcttgcatgttttcacaaatatattaactttattatcaatttgcctaaatgcataaaaatgtgtgctggcgtttttgcgactgaattaaatttatacaccaatttaggaagaaccgacatctttttaatgctggattattccatctaggacagtgacgtagtctgtttgggctgctattacaaaataccatagactaggtagtttataaacaacagaaatttatttctcgcagctctggagactgacaagtccaagataaagattctggctgatttggtgtctggtgaggaccctcttcctcatcgatggtactttctaattgtatcctcaacatggtggaagggacaaggcagctctctgaagcctcttttatgagagaactaatcccattcataagggctccacccttatgacctagtcgcctctcaaaaggccccacctcctaatggcatcaccttgcgggtaaaatttcctaacctgcacattgtgcacatgtaccctaaaacttgaagtgtaataataataaaataaaataaaataaaaataaaaataaaaaatttcaagatagtaattttgggggtacacaaacattcagaccatctcagatagcgtatgtgtttccatttgttcaagtcttctgtggtgtcattcaggcatatttaaaaatttttcttgtataaatgttgttatcaagtttattcctaaactttaatccttgttgctagtgtatatggggctttgtctgtgaatgtatcctccagctgcttattttttgtgtgtgtattaaaagactgctgattttttgtatgttaattttatattttgctaccttaatgacttcttttactggttcagttgatttatcatcgtttctatagggtttttcaggtatactataatatcatctgcatgtagagatggctttacttctctttgtaaaaagtaagttttattgtgtatatctaaggtatacaacacggtgttatgggacacgtatggatagtaaaatagttactatagtggaacaaattaacataacccattatgtcacatagtgacccatttttggttttggtagcagtaggcgctaaaatctattcatttagcagaaatcccgcatcatacttaatagtacaattgtacaaactgtattccagcatgttgtgcactagatctctagtctctttcatcctacatatctgctactttgcatcctctgacctacatctcccgctttcctcctcccatcccctcctccccaccccgaccctgataaccactgctttattctgtatctctgtatatttgagttttgttttacttttatttttttaagattccacatataagtgagatcatgcaatatttctctttctgtatctggattatttcactattatttcattgttatagcataatgtcctccagattcatccatgttttggcaaatggcaagatctcctttttaaagtgtatacatacaacacattttctgtatccatctgtcccttgatggacacctaggttgtttccatatcttggctattgtgattaatgctgcagtgaacatgggagttcagatacttttcaaagatcagctactttcaaaaggtggttattttatttcctttaagtagatacccagaaaagcagttgctgggtcatatgatagttctctttttcactaccatatttttttctaaaatagaaaaatgtagaactaccattttatttactaaaacagaaaaaaaaaatctatttctttaggtacctccatactgttttccataatgattgtccctatctacattcccatcaacagtgtacaagggttcccttttctccacacactcggcaatgtttgccatctcttggctttttgataatagctatcctaatggttgtatggtgttgcctcatagtagcttttatctgcattttcctgatgattaatgatgttgagcactttttcatacacctgttagtcagtgtgtatgtcttctttggagaaatgtctattcaggtcctttgcccgttgtttaaatttgattgtttttctgctatggagttgtatgatttccttacaaaatttggatgctaaccccttattcatatatatgttttgcaagtatttgctctcaatgtgtaagttgccatttcattttgttgattgttccctttgctgtgctttttagttcttcttattcattcctaggaaaatgatctatttctctgctcagttgactaatacttgtaatgcaagattgaataggtgtgaggtagtaggcatgctttccttgttcctgatcccaagggaaagcttcgagtgcccccccaccccattaaataagttactagcattaggacttaggtatatatgttttatcatgttaagaaagcatcctgtggtgcctattttcttaaggcttttctattttttaacataaagaggtgttgaatttttccaaaggctttttcaacatctgtggtgataaccatatgatatttgtctttaagtatattaatatggtggatgatatcaaggtactttctaatattgagccaatctgtattgatgggataaatcccactttgccaaagtatattatgattttttaaatatgttgtttgctaatattttatctagcatttttgcatctacacttatctatccatgtcacacttgcttcataaaggaagttatgaaaatttcctttataatgctgttgaataatttatagagcattggcactctggtactatctgatctttgaaggtttagtagaattgacctgtaatagcatctgagccaggtgcttcttgggagttattccttaataactttttccatttttttctgtaaaaattggccaagttaagccttccagcattagagtaaaaatcttgataatctgtattttcctaggaaattatttatttcatgtgtatttttaatttctttatacacaggtttgaaaagcaacctaattttttctgtttaaatgattatcatttgtcgtttattattttgtatatttgtgctctctccctttcttccttcattaatctgcctagtgagtttgtccattaaaaaaaaaaccaggattttgatttaataaatatacacacattgtttttctactatgtatcttattaacatctgcttatgtattcattcattcattcattcattcattcattttaatgaccgaatctccctggatcactcagtctggagtgcagcgttgtgatcacagctcactgcagccttgagctcctgggctcaagcaatcttcccacctccgcctcctcagtaagtaggactacaggcatgttccatcacgccctgctaaagaatcattattattattattattactgtagaggcagggtctccttatgttgcccaggctggtctcaaacgcctggcctcaagtgatcctcccgcctcagcctctcaaagtggttggattacaggtgtgagccaccaagcccggcaatttctgcttttatgttatttctttatttgtgtttcttttggtttcccgggttgttcttttattagatttttgaggcagtgctttaatttgtctaattttattcgttcattttcattgatgagagtatttagcgctctgaatctgcttccaatcactgctttaactatcttctacagagtctcatatgtaagctcttataatcactcttcttaaatatttctgtaacttcagttggtatctcgtctttatctcgacatttgcttaatagaagactgaacattttttccaggtagaagagcctttgtgctttcagtttgtgttagtaagttctacttttgttgcatcgtgattgcagagggttggttgtaatatttctactttatggaaattagcgaggccttcactgtgaggtaattatgatcacgttttgttaacgtgccatcagcttttgacaaggtggtatattctttatctccaaggtgtagatttatgtgtgtgtatgtatgcctatgtgtgtatacacacacacaatgtatcttattgtgttgtttacattttcggtataggtctctttattgtaccactggatttgccttgtactgagacttgccatgtattaaatctcctattattactgtgcttcaatgtctccataccttttggcattacaaaggtggttcctatgttatttggtgcataagtattcctaagtattatatattcactgtgaattttcaattttaatgttagcatgtaaactttgtcattaaaaaaattacttttagcacctgctttcttattgaacattttactatctggtccactagtttgtttttaacccccagtctccttttaacactcatctactgccttatgaaaaaaaaaaagtttattctctttttctttctatctctctcacttctcttattttacttgcactatttctttttttccacaatataaaataaatgcacgttagtcattttccttgcttcaccttcattttagtattagataccaaatgcttgccatcagatgttgtagggaagattttcctgtcgttacctgtggaatcacaatcccagtttaccctttagaatataagttagcaaacgttttctgtaaagagccatatggtaaatattccaaccagtgggccatagtttgcagacccttgctctagtggagtcctcaggaagggctgatgggtacataatttcctaagttcctgtctgtttttctataagctgtgatattagtgaaggatcggctgagctggatatcaaatcagtacttcagacgtttttctcagcccatttctgagtttagagttttaagtaatattctaattcaaggcaggttttatatcctcaaatgcttgtttgaatggaattaattctgtttgcagggttgacgtacagttccttctgtttcatggttgtttaatatgtgtgaaatttgtcttctgctctttttctctttctggaatgtttttgtaaggaattatccttccttttgttcatttttatgatattggattgttttaccagattcctattttacaggtgctattttctgtcagtgtagaaaaattcaggcctgaaatttactgatttcgtttgcttgttttggtagcggacaaagaagttatgagtgctctgattctgtggttctcttatgtcttgcaagattcttcattttccccttttgtttcttttccccatcattaccaaagtggcaaagcatgcttctccctttctgtttgcccttactcttacccagaagctgtggatttcaaaggctacttttattttattttattttaatttgagatagagtctcgctctgtctcccaggctggagtgcaggggtgtgatctcggctcactgcaacttctgcctcctgggctccagcgatcctcccacctcagcctcccgagtagctgggaccacaggcgcacaccaccacacttggccactgttttaagttttcgtagagacgaggtctcactatattgcctaggctggtctgaaactcctgggctcagtggtcctcctgcctcgggcctcccaaagtgatgggattacaggcatgagccactgcacccaacccaaagactacattctaagatcatctctacccctttaaattacacgtattttagaggtccttccctgtagtccctgctcttattatctgggacacctttttggtatttttttagacttagtctgggctcagtcattttaactgtagtttcggaccaactttaagtcccttgcctcttcctttctctgtgtctcttgcagcttttcttggtctgtctttgcttgccacaaagactagtgatgagagcatgacagatcttgtgctgggatttcatgccttttctccttttactcactactaaagatttggcattatctgtttctaagtaacgatgaggatgtggcttctgtatagatttacatcttcctttctgattggtttatatccttttgacatgaaacattgggaggcaggtgcctgggtggtcgacattgccttatgctgacttacagctgatttcaaatggcattttatcttatctaaatacatatgtgtgtgtatacacacacagacagacagacaccacacacacacacacacacacacacacacacacacacaccaacacagacatttatacacacatacaagtctatttgtattccatgtctatagtagaggtctcttgaagtggtcgtttgatttaccatatatttgttcaatacatatttcatttattgctatctttggtggcaggcaagagactgtgaaaatcttctcaggatttgttaatgttcctcaccctaaagcaggttcatgtcaatggaccaaaaggtgccagccacactgctagagctcgctgcatggagtctgctgagtgatgagcctgcagctatccatgctcttgaggagctcccatgagacctctttgttccattgttcatcactgccttcttgggtgggcagaagatgaaactaaaggccatggtgaggatttggccctcccgttgtctccatgttggaccgttgagtgtaagggagtcacactatgaaatcttgggagccacgattgatggtcctgcagatcctccctgcccagagctcttcccctcggtaaccctatgtacactagagacatagtgagtcatcaggagggtatgctgcagcctgaggcagggggtggcctaacagtctcccaaaggtggttgacggtgaatgctgaggatctctgtgaggttgttggtccaacacttggggtcaccttaaggactctaatgtcttacagaggtgattatggaatagaggtgattgagagtactattgatggattcacctactgggtatgattacatagaagaacaacatggacaccagactggggaggatcggaggagaaggaaggatgggaaaaacaataaaagatgttgagtttgtacaaaaaaatatttgttggtagattgtttacagagtgaagagcaaagataaagggtttgcccctccttcccctcattgatgttgctgggttatattaaaatcagccacctttcatattctgtctcttcctcttcctgcagacggccaaaacggagggtcctggatttaaagcaggacccagacagcagaaccacatgctctgagatcaggagcacattcccattttgttttcagtcttgcgtttactctcagcactctatcctgaaaatagaagaagccaagcgaagtgttaggtgcctggaaattgtacatttagagtctgagtctcggcccatccagggaacgcatgggattgttagtggacatttcccttgatggtaccttgagaacaaggcaactcttttctttcctttcgagtaaagttgagcagagccttgggtccttgcatctctgctgcagagatttgcaaattcatcaagtgtctgcccacaaaagcgtcctgtagtttctggatctgggatgcactgatcacctggaagtaggtcaggcttgtttgagtgaagtcagcacccttttggcacagaagatccaccaggacagacttagtctatctaaaatccttttaaaatcctgtaaggggagaaacttctcaacttttttcactcatcatgagcagatgaacaacctccaggaactcagcttgtcttgcttctgcctcacagatcagctggacaaaatttccgggtgagaggttggggagggacctgggttccctgaatgccccattacgaacaaaagagtgcgactattcttagatattcttaaacactttgtaacctatttctccttccacatcagcacgggcactgctgggtgttttaaactggccaagctagagagtgtggtccctcatgctgaggagaaagacaggattagaaaagtcagctgtgcccagtcagtcagtcagtcagtcagtcaatcaaccatgtgcagacgtgcagacactaagataagtctgtcgacatattggcgaaaaagacaacagtcctgcttttattggagtgtgtagccttctagagaggaaggggaggcattcagtcggagaaataactgacgctgtagcactgatgcacatccccatgggctggtcacaataggtaataccgccagatcgttttgttcctgtagttttcccgaggcttaggacctgaatggagaacctgtcatttggaaattcgtcaaagggaattctcagtcggctgctttcccagacccatccccatcaaataactgaactagatacactgctaattatactgtaggcactaagttaaattctttttcccttaatctgtcccacaaccctctataataattgctattgtgcacatttgaaagattaaaaaactgtatctcagcgtggaaaagtaactttcttagggtcacaaatctattaagtctgactgtaaagtccacagtgttaactgctgttgcaatggatatacagattactttattctagagtcataagtatctataattcagggctgcttgctctaatccaaccctcattcttcagaaatgccttccttttttctctctacagagccctgccatctcatttgtacacactgtatgtgtctttctgtggactttctaccagagagacatcactgtcctatcccagagctctgaggttacccacctaagactgttgagtctgagtaacaatcagatatcctgggaagtttctgagccattccaggctctgctggagacggtctcagggaccctgcagcatctggagatagacaactgcctgataactgattctactttctctgttgtcatcccagccctgagccactgttcccacctctgtgtccctagctttgtcttcaaccccattacaatgcctgtgctcacgagtcttctgcagcacttaacagcgttgatggagctgaagcatgtgatttatcctgtccctgtccattgctatgaacaatggcaatcacatggcagtttggacatacaagcttgctaaagtgcaggcctcattgaaggtgatgctgcaggcagtaccacagaacgacatgaactagaccacccattctcagtgatcttcacaggacaaggagttgtttcatcactgatgtgtggccactaaaatactgagtgttcttgcctgaagcccaatttgtaaagacacataatgtgccattctgctattccaggaaactggtgttaggaagattggatatgtaactgacctccataaaagaaaaactctaagaaggaaacagcagactttacgaagtcttgtgggtctcttgcccattgtcctctacgtcctccttcttgttactgaccacagtgttgggtacgtgacatgggctgacccagtcgtggcacaccatttccctgtccacactgatcggttcacttatgggtacttgacgcaagtcaggacagttgaaacctttcctggatgtttttctggagtaggtgctggttactgaagccaataatattactcactgaggtcctttaatcttcctgtattcatgattgccttaggttgcttatgacaaaccattggcaattaaaatgaaaaacaagaacaacaagaaacaaactatccccactacctactggtgtctttatcagtatattgctatctcctttcctaggtctcagaagcctggggttcagtttgcccttatttcacacagattcaccaaagatctgttattagctaggtactgttcctggtgctaagaatgaataggcaaacaagaccctacaccaagtcactcacagtacagatcttcctatgttttgtctgtttccccgctcttttcttaggggatttgggaaagttattttgcccatctatggcccagaatttttttttttttttttttttttttttttttttttttttttgctttgccccttgcatactctgctcaatccacattggcctctttatgctgttggatagctcatcaagactcaggccgtagcttagatgttacgtcctccgagaggtttttctcttacttccctctccttacttaccccacttctctcccattacttcccttacttcaccatgctgtttttaaatgtaccatgtacatttccttcatggtacacatcattccatatgtatttgctccctctgctcctcccctagagttgcactattcagtatagtaaacactagccacatgtggctactgagcactagaaatttggctactccaaaatgtgatgtacgataactgtaaaacgcacacggtatattcaagacttagtgagaaacaaaaaatgtagaataactaactaataacttatttgtattgtttacgtgttgaaatgataagttactgcaggtcaaagacagtaaaaaaagaagacagagtactaatgtgtttatattgttcaacatgttgaaatgatagcactgcggcaaagacaatcactctcagcattcctattgaatacctccttggaagacccaaccggtacaataaagcaaaggaaagcactaaaaggcacacagattggaaatgaagtcatgaaaaagtgtccctatttactgacatggtggctatgtataaaatttctgggaatttatgaaaaacctcctagaactaatgagtgagtgtgcctaggttgccgtataccaggtcaatattaaaagtaggtcaactctatttttatatacagtcctccctttgcacagttctgatatgcactaaggtcattcaccgtgatttagttaaataacactagtcccttcacagtatgggtcaaatttcagttaccatggtaaactaactgtcagtaactacataaagaccaaacattgctgctggttcttcagtccacaaatcgctactgaaataacagatgagaatcatgatcagtggccagtcatgtcacttctttcaaattctgtttgtgtcgctccacaaatcactatttaaataatagatgagcatcaggatcagtgaccagtcatgtcacttttcttttaaaatctaatcatgtttggtcactgagtatctattatttatttcatgcatcaacagcaaagaatgaagctgagtttcctccttgtctcccagtgaactactcatatgacattttaccaaagaactggatagtttaaaaaggtaattggccaacaaagacagaaacatgcaaacaaatgacaagaaataatgctggaagtggaaattgcaaaacggttttgatggaaaggattaagatatcccagtgaaagtgacacttgcaaaaaactttacactacaggattccttggagatattcatgacacagaaagaacaaagaataaagttgtggaagctgatcaacactcaaaactgagaaacaaaatttgccaagtcacgggaaaaaatgtctactccatatcacaattaataagatgagaagaaggcaagaactgttcatactactctttttttttccatgagaaattctggatttaattttatttggaatgtcaccaacttctctggcataacatatggtataattatttttagaatgtgattactttatgaatatttgaagacatttttatgttttgagcacttttctgaaacaatagcttctgttttagtgcatagtagtggacaaggccagaattgatgtttttctgtaacattaagctagtaatggtagaagcagttagataaattcaagtcccttgactccagtcacaagacttcctctaaattattgtgactttgtaaaatattcttaatttgaattttttttttattaatccaatagttatttacattgatcttaagtaaaatttgtatgtggcggccaggcacggtggctcacgcctgtaatcccagcactttggaaagctgaggcaggcggatcacttgagatcaggagttcgagaccagcctggctaacatggtgaaaccctgtctctactaaaaaaaaaaaaaaacaaaaaacaaattagtcagttgtggtggcgggcgcctatagtcccagctactcaggaggctgcggcaggacaattgcttgaaacccggtaggcggaggttgcagtgagccgagatcatgccattgcaccccagcctgggcaacagagtgagactctttgtctcaaaaaaaaaaattgtatgtggctacttattgttaatttcactttcattgacatttctactttcacttcacagtgctttaaaaataggcaggccaacattcagattcaggaaatacagagaacaccacaaagatactcctcgagaagagcaactccaggacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgggggccaatattcaacattcttaaggaaaagaattttcaacccagaatgtcatatccagccaaactaagcttcataagtgaaggagaaataaaatactttacagacaagcaaatgctgagggattttgtcaccaccaggcctgccctaacagagcttctgaaggaagcactaaacatggaaaggaacaaccggtaccagccactgcaaaaacatgccaaagtgtaaagaccatcgaggctaggaagaaactgcatcaactaacgagcaaaataaccagctaacatcataatgacaggatcggattcacacattacaatattaaccttaaatgtaaatgggctaaaggctccaattaaaaggcacagactggcaaattgggtaaagagtcaagacccatcagtgtgctgtattcaggaaacccgtctcacgtgcagagacacacataggctcaaaataaagggatggaggaagatctaccaagcaaacggaaaacaaaaaaaggcaggggttgcaatcctagtctctgataaaacagactttaaaccaacaaagatcaaaagagacaaagaaggcccttacataatggtaaagggatcaattcaacaagaagagctaactatcctaaatatatatgcacccaatgcaggagcacccagattcataaagcaagtccttagagacctacaaagagacttagactcccacagaataataatgggagactttaacaccccactgtcaacattggacagatcaatgagacagaaagttcacaaggatatccaggaattgaactcagctctgcaccaagtggacctaatagacatgtatagaactctccacccgaaatcaacagaatatacattcttttcagcaccacaccacacctattccaaaattgaccacatagttggaagtaaagcactcctcagcaaatgtaaaagaacagaaattctaacaaactgtctctcagaccacagtgcaatcaaactagaactcaggattaagaaactcactcaaaaccgctcaactacatggaaactgaacaacctgctcctgaatgactactgggtacataaggaaatgaaggcagaaataaagatgttctttgaaaccaacgagaacaaagacacaacataccagaatctctgggacacattcaaagcagtgcgtagagggaaatttatagcactaaatgcccacaagagaaagcaggaaagatctaaaattgacaccctaacatcacaattaagagaactagagaagcaagagcaatcacattcaaaagctagcagaaggcaagaaataactaagatcagagcagaactgaaggggatagagacacaaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatatcactactgatcccacagaaatacaaactaccatcagagaatactataaacacctctatgcaaataaacttgtaaatctagaagaaatggataaattcctcgacacatacactcgcccaagactaaacctgggaagaagttgaatatctgaatagaccaataacaggctctgaaagtgaggcaataattaatagcttaccaaacaaaaaaagtccaggaccagatggattcacgcccccgaattctaccagaggtagaaggaggagctggtaccattccttctgaaactattccaagcaatagaaaaagagggaatcctccctaactcattttatgaggacagcatcatcctgataccaaagcctggcagagacacagcaaaaaaagagaattctagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatacacaaatcaataaacgtaatccagcatataaacagaaccaaagacaaaaaccatatgatcatctcaatagatgcagaaaaggcctttgacaaaattcagcaacccttcaagctaaaaactctccataaattaggtattgatgggacgtatttcaaaataataagagctatctatgacaaacccacagccaatatcatactgaatgggcaaaaactagaagcattccctttgaaaactggcacaagacagggatgccctctctcaccactcctattcaacatagtgttggaagttctggccagggcaatcaggcaggagaaggaaataacgtgtattcagttaggaaaagaggaagtcaaattgtccctgtttgcagatgacatgattgtatatctagaaaaccccatcgtctcagccccagatctccttaagctgataagcaactgcagcaaagtgtcaggatacaaaatcaatgtgcaaaaatcacaagcattcctataccccaataacagacaaacggagagccaaatcatgagtgaactcccactcacagttgcttcaaagagaataaaatacctaggaatccaatttacaaggaacgtgaaggacctcttcaaggagaactacaaaccactgctcaatgaaataaaagaggatacaaacaaatggaagaacattccatgctcatgggtaggaagaatcaatatcgtgaaaatgaccatactgcccaaggtaatttatagattcaatgccatccccatcaagctaccaatgattttcttcacagaattggaaaaaactactgtaaagttcatatggaaccaaaaaagagcccgcattgccaagtcaatcctaagccaaaagaacaaagctggaggcatcactctacctgacttcaaactatactacaaggctacagtaaccaaaacagcatggtaccggtaccaaaacagagatatagaccaacggaacagaacagagccctcagatataatgccacatatctacaactatctgatctttgacaaacctgagaaaaacaagaaatggggaaaggattccctattttggaaatggtgctgggaaaactggctagccgtatgtagaaagctgaaactggatcccttccttacaccttatacaaaaattaattcaagatggattgaagacttaaatgttagacctaaaaccatagaaaccctagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccgtcagagtgaacaggcaacctacagaatgggaggaaaattttgcaatctactcatctgacaaagggctaatatccagaatctacaacgaactccaacaaatttacaagaaaaaaacaaaccaccccctcaacaagtaggcgaaggatatgaacagacacttctcaaaagaagacatttatgcagccaaaagacacatgaaaaaatgctcatcatcactggccatcagagaaatgcaaatcaaaaccacagtgaggtaccatctcacaccagttagaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgatgtaaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtagggacatggatgaagctggaaaccatcattctcagcaaactagcgcaaggacaaaaaaccaaacaccgcatgttctcactcttaggtggggattgaacaatgagaacacatggacacaggaaggggaacatcacacaccggggcctgttgtgtggtggggggcacgggggagggatagcattaggagatatacctaatgttaaatgacgagttaatgggtgcaggacaccaacatggcacatgtatacatatgtaacacacctgcacgttgtgcacatgcaccctaaaacttaaagtataataaaaaaaaaaatgacctgttggatttctactttgatgaagttaatgtcatttttaggcctaaaactttttcttttttaaaaaaatcttcaggtgtttttaaattttatttcattttgttttaagttccaggatacatgtgcatgacgtgcaggtttgttatatagacaaacgtgtgtcgtggtttgctgcacctatcagcccatcacctaggaattaagccccgcatgcattagctatttattctgatgttctccctcccccggtgcccccgaccaggccccactgtgtgttgttcccctccctgtgtccatgtgttctcgatgttcagctaccccttttaagtgagaacatgtggtgtttggttttctgttcctgcattagtttgctgaggataatggtttccagctccatccatgtccctgcaaaggaaatgatcttgttcctttttgtggctacatagtattccgtggtgtatatgtaccgcattttctgtatccattctattattgaaggccatttgggttgattcattgcctttggtattgtgaatagggcagcaatgaacatatgcatgcatatatatttataatggtatgatttatattcctttgggtatatacccagtaatgggattgttggttcaaatgatatttctgtttctaggtctttgaggaatcaccacactgtcttccacaatggtggagctgacttacactcccaccaacagtttaaaagcaatcctatttctccacagcctcgccagcatcttttgtttcgtgactttataaaaaccgccattctgactggtgtgagatagtacctcacagtggttttgacttttatttgtctaatgatcagtgatgttgagcttttttttatatgtttgttggccgcataaatatcttcttttgaaaagtgtttgttcatgttctttgcccactttttaatggggttgtttgttttttcttgtaaatttgtttaagttccttgtagattctggatattagacctttgtcagatggatagactgcaaaaatttccacccactctgtaggttgtctgttcactctgatgatagtttcttttgctctgcagaagctctttagtttcattagatcccctttgtcaatttttgcttttgttgcaattgcttttgatgtttttgtcatgaagtctttgcccgtgcctgtgtcctgaatggtattgcctagattttcttctaggatttttatagttttgggttttacatttaagtgtttaatccgtcttgagttaattttggtataaagtgtaaggaaggggtctggtttcagtttactacaggggtctggtttcagtttactacatatggctagccagttctccaagcaccatttattaaatagggaatccttaccacattgcttctttctgttaggtttgtcaagggtcagatggctgtagatgtgcagtcttatttatgagatctctattctgttccattggtctatatgtctgtttttgtaccggtaccttgctgtttcactgtcaagtgctggaaaaagaacaaaaggaactgtctctcattgtcgatggaagtataaaatggccaagacactttgaaaaacaatttggcaggtttgcatgaagttaaaggtacacttatacagcaatcgcactccagggtatttacccaagagaagtgaaatccttcttcccaggaaaccttccagcaaaacgttcttaattgctaaaaactggaaacatctcaaatgcccatcaactggggaatggataaacaaattgtggtatgtacctacactggaagactactcgacaacaagacagttctaagtactgataacataatatgcgtgccacagaatggatgactctcaaaatacattatgctaagtgaaagaagacatactcaaaagactacatacaatgccatttctttggctttatagaaaagggaaaactagagagagaacaaatcaatcagtggttctcttgggctatagaagatcaactttaaaagggcatgagggcactttatggaggtttggacatgtcctagatcttcattcttgggttgatcacatggttgcatgcttttgtcaaaatgcacagaatggtggactgaaaaggggagaatgttatactatgtctcaaaactcggcaccttgattgttattttgtaacctgcctttctccccactgtgtcctgaatcagcaaaaactctatcggttctagggcgtgattcctgctgtaatccccaactctgacagactgtcatccctgtattcctgattctgacctggtttgcctctgatttggaagatatgctttctcagatcctctgccactcttactcattaaccttactcagagcctcctgaaactcactcagtgcaatacaaaggagggatccacagctgcacagaaggtggttgtcagtttctggcttttccatgattcttctgagatgtgttgactaggagtccctgggcttcatccatagattcattctttcaccaaatatgtgttgaacattttccatatgcggtggattctgtcatcatttcctgtttattctccactgcctaacccagaaccagatgttcacgatgtccagttaacaaacgcttctggagcacatatgatgctctaagccctgtgcctggcaccagaaagacagataaattggaaaagaccatctttgtcatctctagcgtcacatgccctccgtggtggacataaagatctattaagcatgtcttttattttctgtgtcgtgatgctttgacatcctgggccttgctgaccctggaaggcttgctcctcccaggcctggtaaggcaattcttagaaatagtaaacaccttgccctggagcgtgcttttcaaatgcaaacaaatcaacggggatacaatacctcccaaccatgtcctatatagggctctcacaccctgggtcactatccacctgccctaatcaccccaaggccaggtaccaggcaactagggacagcccctatgccccaaggctgcttaaattattcagactagccaatcctaaactggttactctcccttgcctgttccttcccacagaggcagagacaacaacaaatgctctggcttgcagttctcctgtctccctctggcccggaccaaccatggtgcttcgccatgagatttcccatgtctgggcatcctttcttctcttcggaactgtgactaacaatctgtctctccaaggcagtcatttcctgatctgtttcaaatgttctactaatccactctattttaaaacactctcagattcccctttaggatgttttcctcgctctgctgggagtgctgtccacagacagccttcagctaccagcttccttggagagcaccttggctccggagagcctccttgtttttccagtggcccacattcagtgactggtggaggcaggagtataaaatcagacatttttaatcaacgtaagaaaaccccaagggtcatttttagcttcagagtaccccatggagctggctgagggtaatgagacctcatagtagctcatttccttccttttccaaattctgtgttctgactgtgctctccacaggtactcatcccatatgtactctcacataaacatcctgcacaataaaatcagtcacacagactatctgttgcagtgcttcaagcatttgaaaaatatggtggagattgtaatggataaataagattctatggctactactaagctcaactgacactctagaagaagacaaagaaatcagagagaaattattatgcacttgaaagccgactgcgaaagccacagggcttccttgggattatacggagactttcaactcctggcacaggatggcagagaaagcttgtgatttaataatcatagaagtaaacctccaaagaaggttaaatttccacccaaagtaggaccgtttctccaggttcatggctcgcactgggcaaaattgagacccataatgtagtttggaatgagacctctagaaacctgaatttccacaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaagaaatcaagactgatgacaggtatactgaagagtttcgcagcccttccaacccctgccacaggaaactcgggatcctttgttcaattcctggacctgaatcaattttttacatctggaactttttgactgaaaaggaggttgggtacccaggcagagaaggtctgtgcagcaccacagcctgtggacacagtaatgattcacccagacctcccctcaagaggcatccatccgttgattcacgtcaccatgaactgtggaaaggaaaatgcccaggtatcttgagaaatgtcaagcatggagtaggagatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcttcctcttcctcttcctcttcttccttcttcttcttcttcttcttcttcttcttcttcttcttcttcttcttcttcttcttctttcttcttctatcccttcaagcatttattctttgagttgcaaacaatacaattgcattccttaagttattttaaaatatacggttaagttattattgactatagtcactgtgttgtgctatcaagtaataggtcttattcattgtttctggttaaccattaaccatctccaccacttccccaactccccactaccaatcccagcctctggaagccatccttctactttctgtgtccatgagttcaactgatttgatttttagatcccacaaataagtgagaacatcagatgtttgtctttctgtgcctggcttatttgccttgacatgacgatctccagttccctccatgctgttggaaatgacaggatctcattcttcttcatggctgaagagtactccattgggtatgtgcaccacattttctttatccattcatctgtcgatggacacttgggttgcttccagatcttagctgttgtaaacagttctgcagcaaacataggagtgtagatatatctttgacatactgatttcctttcctttgggtatatactcagcaatgggattgctggatcatatggtagctcaatttttagtttttggaggaacctccacacggttctccaaatggttgtactaatttacattcctaccaaaagtgtgggaactttcccttttctccacatccatgccagcatttgttactccctgtcttttggatataagccatcttaactggggtgagatgatatcgaatttttgacttgtgtttctcggatgatcaatgatgttgaacaccatttcatatgcctgtttgccatttgtgtgtcttcttttgagaaacgtccattcaaatcttttgcccatctttcgatcagattattagattttttcctatagagttgtttgaaatccttgtatatgctagttattaatctcttgtcagaggagtggtttgaaaatattttctcccattctgtgggttgtcacttcactttgttgattgtatcctttgctgtgaagaagctttttaacttgacgtgatcccgtttgtccatgtttgctttggtcgtctgtgcttgtggggtgttgctcaagaagtctttgcccagacctatgtcctggagatttttcccaatgttttcttgtagtagtttcagagtttgaggtcttacatttaagtctttaatctattttgatttgattttcgtatgtggggagagataggggtctagttgcatttttctgcatatgggtggtccaggttttccagcacgatttatcgaagagactgtcctttctccagtatatgttcttggcacctttgtcaaaaatgagatcactgtaggtgtatggatttctttctggactcccgattctgttccattgttccatgcatctgtttttatgccagtaccatgctgtcttggttactatggctctgtagtattatttgaagtcaggtaacgagattccttcaggtttgttcttgcttaggatagctttagctattctgggtcttttgtggttccatataaattttaggaatttttttttctatttctgtgaatagaaatagtatcaaaataggtattttgatagggattgcattgaacctgtagattgctttgggtattatggacattttaacaatattgattctttcaatccatgagcgtggaatatttttccattttttggtgtcctcttcaattttcttcatcagtgttttatagtcttcattatagagatccttcacttctttggcctagttaattcctaggtgcttaattttatgtgtggctattttaaatgggattactttttaaatttgtttttcaggtagttcactgttgccagatagaaatgctactgatttttgtatgttgattttgtaccatgcaactttactgaattagttgatcagttattagtagttttcttgtggagtcttttttttttttccaaatataagaccatatcatcagcaaacaaggataatttgacttcttcatttccaatttgaatgccctttatgtctttgtcttgtctgattgctctagctaggactcctagtactatgttgaacaacagtggtgacagtgggcatccttgtcgtattccagttcttcaaggaaaggctttcagtttttccacattcggtatgatactagctgtcagtctgttgcatatggcttttattatgttgaggtatgttccttctatacccaggttgttgagggtttttatcaggaagggatgttaaattttttatcaaatgctttttcagcatcaattgcaatgatcatatggcttttatccttcattctgttgatctgatgtaacaccttgattgatgtgtgtatgtagcaccatcctcgcaacccagggataaatcccacttggtcaagattaatgattgttctaatatattgttgaattgggcttgctagtatttggtggaggatttttgcatcaatatgcatcagagacaatggcctgaagttttctttttctttcattctttttgttttctgatgtttctttgtctggttttggtatcagggtaatactggcctggtaaaatgagtttggaagtactctgtcctcctctcctttttggaatagtttgagtaggattggtatcagttcttctttaagtgtttggtagcattcagcagtgaagccattgggtcccaggcttctctttactgggagagtttttcatatggctttgatctcgttacttgttattggtctgttcgggttttggattcaatcttggtaggatgtattgtatctaggaatttgtccatctcttctaggttttccaatttattgacatatagttgctcatagtagtagccactaatgatcctttgaatctctgcagtatcagttgtaatgtctcctttttcatttctgattttatttgcgtgtatcttctttcactttttcttagttagtctggctaaaggtttgtctcatttgtttaacttttcacaaaatcaactttctgtttcagtgattgttcagtgtattgttttcttcagttcaatttcatttatttctgctctcctctttattatttttcttctactaatattgggtttggtttgctctttcttttctagttctttaagaggcatcgttacattgtttatttgaaaattttcctcttttttgatgtaggcacttatagctatgaacttccctctgagtactgcttttgccatatcccagaggttttggtatgttgtgtttccattgccattcgtttcaatttccttcttaatttctgcattgacccactggtcattcaggagtatattgtttaatttccatgtatttgtacagtttccgaaattcctcttgctattgatttctagtcttattctattctatcgtggtcagagaagatgcgtgatattatttcagggttttggaatgttttacgacttgttttgtgacctaatgtatggtctgtccttgagaatgatccatgttctggggaaaagaatgtgttatctgcatctgctggatgaatcgttctgtacatatctgttagatccatttggtctacagtgaagattcagtctgaggtttctttgttgattttctgtctggaagatctgtccagtgctgaaagtggggtgttgaagtctccagctgttactgtgtcagggcccatctctctctttagctctagtaatatttccttcatgtatctgggtgctccagtgttgagtgcatatatatttaaaattgttacatcctcttggtgaatcgacccgtttatcattacatagtgacgttctttttcttttcttatagtttttgtcttgaaatctattttgtgtgatataagtatagcggctcctgctcttttttggtttccattggcatggggtatctttttccatccctttatttttagcctgtgtgtgctttataggtgaagtgtgtttcttctaggcaagagatcaatgagccttgtttcttcacccattcagccagtctgtgacttttgatgggagagtttttccaatttgcatccaatgttacggttgacatgtaaggacgtagtcctgccattttgttatttgttttctggttgttttgtgatcttctcttcattctttctttccttcttgtcttcctctagtgaaagtggttttctctggtgataagatttagtttcttgctttttattttttgtgtatccattgtatttttttttttttttttggtttgaggttaccatgaggctcaataatactatcttataacccattattttaacctgatagcaactgaacactatttgcacaaacaaacaaacataaagcaagcaagcaaaaagaaaactaatgaaaactctgtgccttaacttcatccccccacgttttaatattttgttgtttctatttctatatcattgcattgactatgtctcaaaaagttgttctagttattaatttttattggttcatcgtttagtctttctacttagggtaacacgagtttgtacaccacagttacagtgtcattgtattctgtgttcttctgtgtccttactattaccagtgacttttgtaccttcgggtgataatttattgctcattaacgtccttttctttctgattgaagtacacccctcagcatttcttgtaggataggtctggtattgatgaaatctctcagcttttatttgtctgggaaggtctttatttctccttcatgtttgaaggatatcttctagggtatatactattttagggtaaaagcgttttttgtttttttgtttgtttgttttccttcagcattttaaatatgtcataccaccctctcctggcctgtaaggtttccactgaaaagtctgctgccagacatttggagcgccattgtaaattacttgtttcttttctcttgctgctttcagcatcctttctttatccttgttctttgggagtttgaatattaaatgccttgaagtagtcttctttggattaaatctgcttggtgttctgtaaccttcttatacttggatattgatatctttctctaagtttgggaagttctctgtaattatctctttgaataaactttatactcctatctcttcatctccctcctctttaagcctaataactcttagatttcccccttcgaggctgttttctaggtcctgtaggcatgcttcatttttgtgtattttttcttttgtctcctctgactgtgtattttcaaatagcctgtctgcaggctcactaattctttctttctgcttgatcagttctgctatcgaaggactctgatacattcttcagtatgccagttgcatttttcagctccagaatttctgcttgattctttcagattatttcagtctctttgttaaatgcatctgatagaattctgaattcctactctgcattatcctgaatttctttgagtttcctcaacaaagttgttttgaattccctgtctgaaaggtcacatacctctctgtctccaagattggttcctggtaccttatttagcttatttggtgaggtcgtgttttcctggatggtgctgatgcgaatatttttttcttcagtttctgagtatgtgaactgttaggtattaattgtagtcttcactgtctgggcttatttgtagccgtccttcgtcagaaggcttttcaaatatttcagaggacctgggtgtttggatctaagctgtgtctgcttcagggggcaccccaagctcagtaacgctgtggttcttgtagactcatagagggcaccaccttgatggtcttggacgaggtccgggagaattctctggattaccaggcagagactcttgttccctttccttactttctcccaaacatacagagtctctctctctctctctgtctctgttctgagccacctaaagctgagggtggaatgacacaagcacccctgcagccaccactatgcggccaccactactatgactgcactgggtcagacctgaagccagcacagcactgggtctcccccaaggcctgctgtaattactccttggctactgcctttgtttgctcaaggccctggggctctacaataagcaagtggcaaagccagctaggactgtttttcccttcattggagagaggtcccccaagccccaggtgggtccagaagtgccatctgggaatcagggactagcatcaaaaaccttagaaggctacctgtggttctaagtattgtggctgagctgtcactcaaaccacaggacgcagtctttcccactcttccctccccttcccaaaggtacaagagcctcacactgtagccaccgccaccctaggccccgagcagtactggcagactactgccaatgttcccttaaggctcaaggtctcgtaagtcagctgtcgtgaatgctgcctggcctgggactcacccttcggggcagtgggctcccctgtggctcagggcaggtccagaaatgcagtccaagagtccagtcctggaactggggactccaagggtctgcttgatgctctaccccactatggccatactggtacctaagatgcaaaacgaagtcccctttacttttccctctgcttttctcaaactgaaggagttttgccccatagccaccacttgctggttatgtaccaagtctcacctgaagccaacaagtctcagaggttcacccaaggccctcgatgtagtgcctgggcatcactgctggttattcagggcccaggggctcttcagtttgcaggtggtgagtgctgccaggactaggtcctttccttcaaggcagtgggttcccttctggcccaggacgtgtctaggaatgtcctctagtagctaggtcctggaacaggggccacgtgactctgactggtgccctatcttgctatggctgggctggtatcccagatgcaagacacagtcttcaccactgttttctttctcccctcctcaagtggaaggaaggggtctccttcggagccacaaggtgtgcagcctggggttaggggacgggtgatgccagcactcccttggctgccccagctggtatctcagtatgtcgtgtgaccccccccctcccccgacccctggtccactgtctctgggcctaattcaacaccaggactcacctaagagttgcagttcttttttttgtttgtttttttgagatggagtctcgctctgttgcccaggctggagtgcagtggcacgatctcagctcactgtaagctccgcctcccgggttcacgccattctcctgcctcagcctcctgagtagctgggactacaggtgcccgccaccacgcccggctaatttttttttttttttgtatttttagtagagacggggttccaccgtgttagccaggatggtctcgatctcctgacctcgtgatcctcccgcctcagcctcccagagtgctgggattacagccgtgagccaccacgcccggccagagttgcagttcttatggcctagtctgcctttcaaatttacttggagacacagagtgctgtagcctgccatggtgaggtttgtgggaactcaagttctgatcactgggatcagtgattcccctctggctagggctgctttaaatgctccctctgttgggggggcatgagctgagtttggtccggttttcctttctgctctaacaggatagcactgaggtcattgcttcacaaatgctgtggtctccctccccctgcacccagagatgctctccacaccatgctgctgtggccaggggtgggggaggggtggcgtcggtaattcaggactatgttttggttctcagggagaatgcttccaggttttggcctttgagtaggatgttggctgtgggtttgtcctagatgactcttattattttgaggtatgcttctctgatgcccagtttgttgagggtttttgacatgaagggatgttgaatttcgttgaaaacctcttctgcatctattgagatgatatgtggttttcgtttttagttgcgtttatgtgatgaatcacatttattgatttgcacatgttgaaccaaccttgcatcccaggagtagggcctacttgatcgtgatggattagttttttgatgtactgctggaatcaatttgctggtattttggtgaggatttttgcatctaggttcatcaggaatattggcctgaagtgttgtattttcactgtgtctccgtcaggtttgggaatcagaatgatgctggcctcgtacaatgagttagagaggagtcccagttcctcaaatttttggaatagtttcattagggattggttacagctcttctttctgtgtctgatagaattggactgtgaatccgtctggtccaggcctttggttggtaggtcttttttattactgattcaagtttgaaactcgttattggtctgtccagggattcagtttcatcctggttcaatcttgggaggttgtatgctcccaggaatttatcgatttcctctgggttttctagattatgtgcatacaggtgttcataatagtcgctgaggatttttgttgttgttgctgcatttctgtggggtccgcagtaatgtcacctttgtcatttctgatggtgtttatttgggccttctctctctttctttcttttccttgtttgtctagctagcagtttgtcgagcttatttattttttcaaaggacctttggttcctttggtttctttgaccttttgtagggtggttcacatctcaacttctttcagttcagctctaatatttgttatttcttttcttctgctagctctggggtcactttgctcttgtttctctagttcctctaggtgcgatgttagattgctaatgtgagatctgtctgactttttccatgtaggcacttagcaccataaactttcctcttaacactgttttagctgtgcccccagagattctggtatgttgtacctttgttttcaatagcttcaaagaatttttttgaattctgcccaaattttgctctttactcaaaagtcattcaggagcaggttgtttaatttccatacaattgtttggttttgagacatcttcttggtattaatctctattttcattgcactgtggtccgagagtgtggctggtaatgatttcaggtttgtttttgaattttttgagaattgctttacggccaaacatgtagtcgaccttataatataattgattggttttgaaagatctatatataattgtttgcctctgagagatcttcctgctacagatgtctatttttattgcactgcggtctgagagtgtggctggtatgattccgggtttgtttctgaattttttgagaattgctttatggctgagcatgtggtcgaccttagagtatgtgccctgtgcagatgagaagaatgtatattgtgttgttgtttcgtgcgatgttctgtggatatctgttaggtcaattctgtcaagtgttgagtttatgtcccgaatatctttgttagttttctgccccagtgatctagcactgtcagtggggtgttgaagcctcccactatgattgtgtggttatttaagtttctttgtaggtctctaagtgattgttttgtgaatctgcgtgctccagtgttgggtgcatatatattaaggatagttaagtcttcttgttgaattgaaccctttatcattatgcagtgcccttctttgtcctttctgatcattgtgggtttaaagtctgtttcgtctgaaataagaacagcaacctctgctcttttctgttttccatttgcttgatagatctttctccatccctttactttgagcctatgatgggtgtcattgcatgtgagatgggtctcttaaagacggcatgcagttgggtcttgcttctttatccaacttgccactctctgccttttaagtgggggcgtttagcccatttacattcaaggttaatattgatatgtgaggatttgatcctgtcactgtgccgttagctggttgttatgtagacgtgattatatagttgcttggtagtgtcagtgggctgtgtacttaagtgtgtttctgtggtgacaggcaacgaccttttgtttccatgtttagcgctcccttaaggacctctggtaatgcagatctgggggcaatgagttcccttagcatttgcttgtctgaaaaggattttatttctgcttttcttatgaagcctagtttggttagatatgaaattcccagttggaatttcttttctttaaggatgctgactattggctcccaatctcttctgacttgtaagagttctgctgaaaggtttgctgttagcctgatggggttccctttgtatgtgacctgccccttctctctggctgcttttagtggttttcctttcaccttgaccttggagaatcttatgactatgcatcttggggatggtcatcttctgtagcatctcactggggttatctgactctcctgaatttgcctctctacctgtctagcgaggttggggaaatgtctgtgggcaatatcctcaaatatgttttccaagttgcttgctctctccctctctttgtgggacaccaatgagtcataggtttggtctcttcacataatctcatatttcttggaggttttgttcatttttgttaattctttttttccttgttttagtctgattgatctgattcaaacaactggacatcaggatctgagattatttcctcaggttgttctagcctgctgttaatacttctgattgtattatgaaattcttgtagtgagttttttagctcaagcaggtcagtttggttctttcttaaaatggccatttaatctttcacctcttgtattgttttattggattccttatattccttggctgccatgtcaactttctcgtgaatctcaatgatctttgttgccatccagattctaaattttatgtctatcatttcagccacataggtctggttaagaaccattactgcagagctagtgtggccatttggagacaagaagacactctggcttttagcattaacagagttcttgggctggttcttcctcatctgtgtgggctgacgttcctttaatgtttgaggttgctgtcctgtggatgggcctttttgcttttacattctttgatgaacttgaggttttgatgtggtataagtcaatttagtcaattggcttcatttctggatgattttggggaaccaagacacagctcagcgctcctgggctgcatgctctacccctgggggctgggacgtgtccatggttttttttgtttgtttgtttttgtttttttttttttttctggactctgaaggtttactgcctgctcttctggaggggctgaggtgttcccattccgctggcaacagcactctgatgggatgttccggccaaagtacttccgtggggcagcggtagggcagcaagggcccccaaatgcatgggctcaccagcgaagcagtgcaggaaggctatgagtgagagtgcatcggtggaggagggctgcgggagggtgcacttgtctgcaggggaccacctgcagaagatccccaactgctaggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtggtgaggcttggggttgggtgcccatggccatgcttcagtgcagcttttcccatgctaaaccctctggactccatgcaggcaagatttctatctctgccagctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcagggtctgtgtccttcctccatccattttcaatgccttctttccaaagatctgtttggaatgtgctggtcttcttgatgatcgggtctcttattgggaggagttcttcctgtctgcatctggtcagccatctttgccccaaagccttcagtaatttttaaatctgagaatgtgttaattttccccttcatttttgaaggatggttttgctggatatgtaattcctgcttgacaggtttctccttttttagaactttgaatatatcgcctactgcttgaggactacatatctcttatgagatacagtctccttactagttatagtaaggagttatcagtaataggaattatcagtaatcaaaaccttccaacaaagtcaagtcttgggccagatgacttcattggtgaattctaccaaacatttaaagaagaattaccaccattccttctaaatctcttccaaaaaattgaagaagagggaacacttcctaactcattccataaggccagtgttagttaccatgataccaaagtctgccaaagccacaacaagaaagctacaaagcaatatcccttatgaataccaatgttcagaatcctagatgaaacgctagcaggcagaaccttgcagtatattgaaaggattacacacccatgactgaatgggaataattgctgaaatgcaaagatgattcaacacatgaaaataaacccatgcactatattaacagactgatgataaaagaccgcatcaccatgtcaactgatgcagaaaaagcacctaacaaaatccaacatggttttataataaaaaccctcaacagattaggaagagaaggatacttccttagcgtgacataaaccatatatggaaatacctatagctaacgtcatactcaatggaaaagactgaaaggttttcccctaagatcgggaacaggacaaggatgcctgcttttgtcacttctaactcaacatactattgaaagctctagacagagtaattaggcaagagtaagaaatagaaggcatctaagatggaaaagaagaagttatcccctgtcacagacgacatgatcttctatgtagaaaaccctagagattccacaaaaaaagctgttagggctaataaatgaatttgtcaaagttgcaagatagaaaatcaacacaccataaccagttgcatttgtgtacactgacaatcaacagtccaagaataattaagaaaataattacatttacaatagcacgaaaagaatagaatactcaggagtagacgtaatcaagacatttaccttgagaactacaacactgcttgaagaaattaaagaagacataaataagtggaaagatgtcctgtgttcatgggttgtggttaattttgcgaaaaagtctttcctgctctgaggacataaacttaggcactctcgtaattgttctaacattttttaaaatttcaatagtttgggggcatacaggtggattttgattacgtggataagttcttcagtggtgattcctgagattttggtgcacccgtaacctgagcagtgtacactgtacccaatagatagtcttcttttatccctcaccctctttccacctttccctccgagtcccctaagtccatcatgtcattcctatgcctttgcaccctcataggttagctcccacttataagtgagcgcatacgatattaggatttccattcctgagttacttcacttacagtagtggctttcagctccatccaagttgctgcagaggccattatttcgttccactttatggctgagtagtattctgtggtgtatatatgccacatcttctttatccactcgttgattgatgggcaataaggttgcttccatatttttgcaattgtgaaatatgctgctataaacatgcatgtgcttgagtctttttgatataatgacttgtcttcttttgggtagatacccggtagggggattgctggatcgaatggtagttttacttttagttctctaaggaatctccataccgtttcccagaatggttgtactagtttgcattcccaccagcagtgtaaaagtgttcccttttcaccacatccactccaacatctattattttttgactttttaattatggccattcttgccggagtaaggtggtatctcattgtggttttaatgagcatgtccctgataattagtgacggtgagcattttttttcatatgtttgttggctggttgtatatctttcttttcttttttttttttttttttgagaattgtctattcatgtcctttgcccacttttggatgggattttgcttttttcttgccgatttttattgagtttcttgtagattctggatattagtcctttgttggatgcagggtttgtgaatgttttctcccactctgtgggttgtctgtttactcttctgagtatttcctttgccgtgcagaagctttttagtttaattaggtcccacttgcttatttttgtttttggtgcatttgcttttgagttcgtaggaacgagttcttgtaaatttgtttgagttcattgtagattctggatattagccctttgtcagatgagtagattgcaaaaatttcctcccattctgtaggttgcctgttcactctgacggtagtttcttttgctgtgcagaagctctttagtttaattagatcccatttgtcaattttggcttttgttgccattgcttttggtgttttagacatgaagtccttgccgatgcctatgtcctgaatggcattgcctaggttttcttctagggtttttatagttttaggtctaacatttaagtcttcaatccatcttgaattaatttttgtataaggtgtaaggaaggaatccagtttcagctttctacatatggctagccagttttcccagcaccatttccaaaatagggaatcctttccccatttcttgtttttgtcaggtttgtgagagatcagatagttgtagatatgtggcattatttctgagggctctgttgtgttccgttggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttacagtagttttttccaattctgtgaagaaagtcattggtagctcgatggggatggcgttgaatctataaattaccttgggcagtatggccaaaacaaccccatcaacaagtgggcgaaagatatgaacagacacttctcaaaagaagacatttatgcagccaaaagacacatgaaaaaatgctcatcactggccatcagagaaatgcaaatcaaaaccacaatgagataccatctcacaccagttagaatggtgatcattaaaaagtcaggaataacaggtgctggagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacgtggaaccaacccaaacgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcgctcataggtgggaattgaacaatgagaacacatggacacaggaaggggaacatcacacaccggggcctgttgtggggtggggggacgggggagggatagcattaggagatatacctaatgttaaatgacgagttaaggggtgcagcacaccaacatggcacatgtatacatatgtaacgaacctgcacgttgtgcacatgtaccctgaaacttaaagtataaaaaaaaaaggaatgaattcattacctaagccaatgtctgcaagagtttttcgatggtatcttctagaatttttgtggtttcaggtcttagatttaagtctttgatctatcttgagagttgatttttgtaataaggtgagagatgaggatccagtttcattcttctgcatgtggcttgccagttttaccagcaccgtttattgaatagggtgccctttcctcgctttatgtttttgtatgctttgtcaaagatcggttggctgtcagtatttggcttcatttctgagttctttattctgctccattggtctacatacctgtttttatgccagtaccatgctgctttggtaactatagccttgtggtataatttgaagccaggtaatgtgatgcctcctgatttgttctttttgcttagtattgtgttgattatgcgggctctcttttggttccacgtgaatttgaggatatattttttttctagttctgtgaagaatgatcatggtactttgattggaattgcattgaatttgtagatcgctttgggcagtatggtcattttcaccatattgattccacccatccatgagcatgggatgtgcttccatttgtttttgtcattgatgatttctttcagcagtgttttgttgtttttcatttagagacctttcacctccttctttttccactaaggtttcttttttttttttttaatttctggaatttatattgtgtatggagtgagatagcaatctcctctctaaaaaatgggtataaccaatggatccagcactatatattgaatagcctgtcttttcttcagctaaccttcaatggcaaacctctcatgccacgttttcctatatttaatgggctctctatcctatcaattgtattggcctagatgtcatataagtgaactatcttaactatcttaattattaaaacttgatatcttgtaagccatgtcccttctgatcccctctactttgttttaatattcttggatattaagcgcccttggtccttcagtatgcattctagagtcatagagtctattgttccgtagaaagctgtgttggattttttattggaatcacgtcaaatatacaggttaagtggagaaaaccgtcatctttatcatagggattcttccatgagcatgctttatatctgcctaatttggaactaatagctctcgataacatttgataattttctcatttaaagtctgaagcatctttgttagacttatttccatgtaccttactattttgtggcagttataattggtgttcattgaagagttgtttttcctctaagtggttgttgctggtttgtaggaatacagttgattttcttcttagctgtaattaatgctgagagtttgtagattatctcaggtttttccatacaggtaaataatatattgtctatatagatatgatcgtttgggtgtttttaattccaatcattatatcttttatttattgcactggctagaaccgccactgttgagcagaaatgacaatattgagcaaacttgtcctgttcttgatttttaaggacaatccatgtaaatcttcaccagtgtgcacagctgttggtgcagattattttgtagatatgtgttttccatctgttttttcccagtttggcaagaattgtgttttggtttgtttttgtgtgttccgtgaacaggcactggattttatcaaatgattttaccctgtccattaaaatgatagcccaatcttgtttctttccattaatgggatgatttacattaacattcctttctaatgttaaggcatttttacactgctgtgatacaccaaacttgttctggtttattatcatttctgtgcgtcacttaagtctgcagtatttaatttagcatttagcttgaattataaatttcctttctcctattatacttacctcattttagagtcaagattatcctcataaaatatacttgggagtgtaagcttttatcttggtctttggtgaagtttgtatgaacttggaattaattatctactccttgaatgtttagtggaattttccccgtgttcctggtagttttcttgacgttgttttttttttttttgaactaaagatctattttttttaatgtcaacttttatttttagatagaatggttacacatacaggtttgttacatgggaatattgtgtgatgctgaggtttggggtgtggatcccatcacccaggttttgagcatagtatccaataaataggttttcaacccatatcccctccctgccccctcgagtagtccacagtaatttctttaatcgttgttaagtctagtcaagttttctatttcttctatagttagtttaggcaggatatgtttctctttcaaaatttctacgttgtctaggcattaatttatatcagtatgaaattgtttttggtattatcttgtttattgtttatgtctaatcatattctgcttgttaatttttaatattgttcctttgtgttctctctctctctcctcctgtccactgctcttcatctttctcccttcaccagtattgccaacgttggctgtttcgtcagtcttttcagaaaccaacttttggtttggttgattttgttgattctctctattgtacttttctttctctctttctttccatatatatatatatatatatatatatatatatatatatatatatatttagttttgtttgttttttttgttttgttttgttttttgagacagagtctcactctgtcacccaggctagagtgcagtggcgccatcttggctcactacaacctccgcctccctggttcaagcgattctcctgcctcagcttcctgagtagctgggattacctgcgcgtgacaccacgcctggctaatttttgtatttttagtagagacggagtttcaccacgttggtcaggctggtctcgaactcctgaccccgtgatccgcccgcctcagcctcccaaagtgctgagattaccatgcccggcctctattgtacttttcttttatacctcattgctttctcgcctcatattattttttctttttatttttctgcttttcttttgctcttctttcaagcatggatatgactctacacagctgcacccaggggtgacctttaaagacagtgcagagaaaagtatctccctgttgtggggtggggggacgggggagggatagcattaggagatatacctaatgttaaatgacgagttaatgggtgcagcacaccaacatggcacatgtatacatatgtaacaaacctgcacgttgtgcacatgtaccctaaaacttaaaggattaaaaaaaaaaaaaaagaagtctgttgaaaagatacactatggaccttgggctcaaagacctacggtaggaagctctgagtaggatgtgagaaaaatcaatgtgacagtgaaaaacaattattatgtacaactcttttatattctaaagaagggggttaagaataaagatccttgatgtgctgatcagggtgatgagtctgaggattcagtcatcagaatctcacagagataaatggctccacagagaaaagagatttgaagggaatgagactgttcaggaagaacaggagctgatgcccatccatctcatgagggtatgaggaagagaggcaagatagtctaacgcagactgtttggtgacatttcactgggacacgtgccattgaatctcccccgtttgtccccatgaagacgtctacaaatgcgcattgaatgttttggtaatcagatttatcattggtttgggggtggggggtgaatttcagcatctactgtcaagcggggcaagagcaaaggtagctcttggcgccctaatagtactctgcttcaataagttagctgtggtcattgcaaattatgtcagcagaagttgagtggttaaacatgggctttaccttcagagaaacggaacaattctgaaaaagaagaaaagagagaagatccaaacttgccacaggcacatgcagcaggttctccagtcctctttagagtggtttagctgtttaaaaacattgggtgggttctggcacgtgcctagtgttttccactcttaccctgtttatgcacctctgtcctgcttccttgatcagctgcccaccagtcctgagattctcccaacatggatcacttctcagtcattgagaagggaatatgagaggaggtctagatcattatgttcttatttggcagtttaattgttaaaaggaacattcaccaatatactcccacctcgacacccacagaacgtaaaaataaactgttgtaggatgtggtacagtggctcttacagggtatactagagaagaatgaggatgtgaagaaaactggggttcacattgagcctggggtggaaatcctggctgttcagggtggtggaaagtgtagggctgattgccattcctatgatgccttccttgaatcctccggtaagtatccacatcttctagtctctgacttcgaccatatttatcacctctaataccagagttctgaagtttgtttcttgctggattagtttctgtggtcttctaaggacttatgacctatacgtctgttttatagcctataaaattttgctaacatatttttcttggtgtggtgtcgttgtctggtaccttctgattttttgtcccgctttgcaccccccgcccccccccacttcattattaggggttttctggtgggagcataaaaagcatttgcactcagtattcctgaagtaatcagaagtaaattgatagattctctaatgttccactaccctttcattcctggaacgaacgcttttttaatagacatatactagttaagtttagtaataattaatttagaagttttgcatctgtaattatatatactataatttttactgctcgtactgtcctttttgaactttcagtgtctaattttaccagcctcatgatagagactttaaaaataatctcattgactttactgacaaatgtcttattatgtctgaaatataatggatctagaacctgaaaaaattagttaatgaaatgcactgaaatgaatggaaagtaggatactcttctatggtttttaaaaattgaggcatttactgagtcatatagtggcccccgccaaattcctgtccaccctgaacctgtaaatgtggcagtatttggaaatagtgttttttcagacgcagtcacattaagatgagatcatattgaaccaggcagggtaggccctaactccaatatgactgctgtccctataaatagaggtagatttggacaaggagacacagacacataggggagtcgcgtggagacagagacagagactggagtaaggcattacaaaccaaggagtgacaaggagtaccagcatccaccaggaactaggagagctaagaaaggcttcttccgtcagatggagcatggccctgctgacatcttgattttgtacttctagcccccagaactgtgtgagaataaatttatcttgcttttagccacccagtttgggtattttgttatggcagccctaagaaactaatgcagattttagtgctaagacgtgggttgttcctgtcacaaatgcctaaaaatatggaagtggctttgtaattgggtaatgactagaggctggaagacttgaggcacatgatatgaaaaccctagattgccttgaagagaccgttggtagaaatatgaatgctaaaggtgattcttgtgagagctccagaaggaagtgagaagagttgtagaggaagtgcttatcatcttagagaacacgtgtatcattatgaacagaatgatgctagaaatatgaatattcaagctgcttatgatgccgtctgagatggaaattagacacatgttaatgagcactggaggaaaggtgacccttgtgatagagtgtcagaaaacttgaatgaattgtgtagaaagcaggtcttgtaagcgacgaacttggatatttagctaggagatttccatgcaaactctggaaggtgtggccttgtctctttatagtaaaacgtgagagtaaagagataagttgaggaaggaactgttaagccaaaaggaagcacgcttgatgatttggaaaattcacagtctacccagatagtgcactatggaaacagggccaaaagtgtggctgaacagccatttgctaatgagactagctaggcatgtggacccaaccaaccaccttggccctaagccaggaaaccagataggttaatccaggaaggacccacacagagcctacatatctagttgtgtggatccccttggcatctgcaaaaacatggcaaggattttgagagttttatactagcagaaacgctgccagcctggactgaaatgtccagagatgggacaaaaatgaaagaagaatgtctctgaaggcagaaacatggaagaccagaccagaaatggcattgtcattaccctggagggctggatggactgagtccctgacccagaaagccaggaagatggggctgcctccctggagggtcctaaagtttggggctgcctccctgaagggcccttgggacagaagattgagccatggaagttcactctcggcctgaaacttaatggacttttttcctgctgggttgtgaacctgccccagagcgacaacccctttaatctttccaccttctcccttttgtgaaggggacgtctaacctacgtccgtcccactgtagtattctggaagtagataacttgttttctagcttcatgggtctgcagacagagaggaacattgccccagggtggaccttgcccaaagtctactcggtaagatcctgacaattttagatgagattttggatttagggttaatgctggaataggtgaagatctggaggatttggagatggggtgaatataatttactcacggtaagaatgtaaatattggggagccagagggcagactctattgggttgaatagtgcgtgcacccccctccccaaatttatgtctacctggaatctgtgaaggtgattttaattggaagcaaggtctctgtagatgtaatcaagtgacgataaagtcacactggactagggtgtgccctaatccaatgactggtatctttataagaagaggaaaattgggacaaagagacagacacacagggagaataccatgtgacaaccgaggcagagattagggttaagctgccacaagccaaggaatgccaaggattgccagcaaccaccagaagctaagagagatgtgtggtacagattctctctttaactgccaccctcaccacaaggtaccaatcttgctgacaccttgatttcaaacgtttggccaatagaaatgtgagagtttaaaattctgttgtttcaagccacccgtttatggaaatttgttatagcagcctgaagaaacgaatacagcacttgagtcctgtttagcaaggatcaagctagagctctttggtcactgtgtctagcctggtgaacatcagtggctgcttggggcagccatatggacattatttgtgattgtgcatccctgagatgggcctggggatgagcccttgtgagttatgcaaaaaaaaaaaaaaaaaaaaaaaggaaggaccccagcaccccagggagacttaagcatggcaccaagttgcctaacagtcattgtttttcaggcatgggtaccacagttgctgccgtagcatgcattctccttaccctcaagcgtattcatgtgcatagccatggcagccggtgtcccagggactgatgattaaataaagagggtggtggaggaggagcgtttggcactcagctgctcccacagtgctaaaccacttagcccttattctatgcagagctatatctaagtttcatttaattctcacgccaaattgaggatcatgatggaaaattttgtctatagctaaatagaaagctgaaactaagaaaggtcaagtatcatgaagtaaaagagaggttctattagtaatagcaaaaacttggacttcaagcactgtgttcctttcatttgtttttaaattttatttattttttaattagacaaaattgtatatatttacggggtacaatgtggtattttgataagtgtatacatttagaaagactaactcaagctaattaatatatccatcatctcacctacttatcacattttgtgttaagaatatctaaaatctacttttaaagcaatattgaaatatatgatacgttgttattaactctgctcactatgctgtgcaattgatcaccaaaacatattcctcctgtctaactgtgctccagtcccaaatcctcagcagtaaaatgcccctgtctctcctcagtgaaaccactcttgattaataaagtagtcttagtgtagtcttacctggggcttagttgtcccagatctttcctgccatccaccagaacctctttgcctgtagagagtcttctgaacttgagaagctgcaggattatgaaagcccagcatgtcatacacttgcctgctcattgctccttctctcaccttggctctcttgtctctcatagcaatgtcatctcaatatcgggcatcatgaacataactcttccggcctgtcacagaaatgaagcaaataaactgatggaaaaaaaaccataaagaaacccacaataccagccacaagtcaaaccatttaaaactgttacttttgtattagtatcagacaaaatagacgttaagacaacaataattatttggaataaagaaggccaccatgtagtcatgatagaacatttatcaaagagctaaaaagtctgaacttaacatgcactcaaaaacatagccaagaaatacataaagcacgatgttcagagttacaagaaggttgccacaataaaatataaaagtgcactattttagagttggggcagttccaagaagtagcaagatccagggagtgcccctgagcatggcagtcaaataagaggtcttgcgaccatgaggcttggaatcagactggttttctacatggacattgaaatcacccaggactgtgacaagattaggtgtagaaactctgaatgagacataaaaatctttgaccaaaagaccaatacgttggttttattttagaaagccatctttgtaagatgcccaggatggccataaaattgaatgtgtattggtcagggatatttaaactacaactaacagaaagtgcaagtctcgctggcttatccaataggtaaagacacttgcttatataactgagagttcagaggcagagtgagtttcatggttaactgagccagtaacggaaagatgtaaacatccaggctaaatcttgacccaaccactgctggattgggcattggattattggattagattagactaattctgggcccactcttggagctaagaaagtggccatatatcctcaagcacatgactctactgggaggagatacactgatggaggcctgagcccagccaggaaggtgaggaatgtatattgtgtaggtaaacaaaaatgtcacctgcaggtacagactcaaattatatataccgctatgagcatagtaaccacaatattcaagtccttcttgtgtcctaatagagtgactcttcgggtaacaaagacggatattttattcaggagctacctatattgaattcatgaataggcggttacaaagcatgagagctctcccctgtgcagtatatgttttggaagaacctcaacaggcatccactgtgggatgcttaaatcccattttcattctttttcgattcgtcggcaaagttttctattcgctcttgtcctgagatgatgttgtgttaggattatttgaccagaggtaactgaattcttcgtatttaccgttaagttttgtctttctgtaaacacgcgacacagacttcacaaagatatcaaagatcctcagatttcagtatggaacaaccttaaaagccctgggtctttagaagaaagtcagactcagccaggcgcggtggctcacgcctgtaatcccaacactttgggaggccaaggcgggctgatcacgaggtcaggagatcgagaccatcctggctaacgtggtgaaaccctatctctactaaaaatacaaaaaaattagggcttggtggcacgcgcttgtagtcccagctactcaggaggctgaggcaggagaatcacttgaacccgggaggcggaggttgcagtgagccaagatcgcaccactgcactccagcctgggcaacagagcgagagtccgtctcaaggagagaaaaaagaagagagtcagactcctataatgtaccaaaattaaagaacaaccttttcctctaatgcacacatttattcacgctttgaaaagaatatgtttccataacaataccaaatatgcatatgaaaagaaaattaaaaataagataatcacccaatctgcgaatatgcagatttgaaaattaattatcaatatataaatggaagctcttaataaagacgttgtagtatcacatagacaagatatgtaatgtgttattgctcatgttttgccttagtctgcatctacactgtgaaatgagcttaatcgtgttcactggttcattatttgctaactccttgattgacttagccagttgagcaatccagccagtgagtcattctataactgttgataaactacgtgatgttttaaatccaaggattaaaagaaaacacaaacattatatatcttgccttttttcacaggatctaatcactgataataaattatcagtgataagctgatcacaagaaacaaggtataaatgctgcatacactaaaaagaaaacaatgtggctgactatgttttaaaaattatctgacagtattttccaacagagtatttagaactatttcttgaattgcaaaatatagttgccttgagcagataacaggaagcaatctgggaaatttaaaattctctacttttaatacattagaaatctttgaatcataattgctcattgttttaaatggtcttcacagtggagggggtttggaccagagagctgcatcttcacaaatggcactgctcttcagtaaacaccctctatggaatccctaccttttcactcctctccatcctttgcctgaaggaagttttccttgtagacataattttgtatttgtatgttgtggtagtcctcaaagagtgagcctattacctagagctgttgaattttaccttgcattgaggggttggcatattgagcaatttgccagggagcactatctgcaactgcttctctttttttcctattgcttggcactgacataaagttacttctagctacgctaatgaatttcacgaaggaacacagaaaaacaggtcttgaatgtaatgcccgtaatgatagagtcccatcttatgctttcccttgtatgctgttgctaggtcagtcatttttactttctgaaagttaatttacataggacacctagttcaggtgtatgtatctgttcaaaccaaaagcgttagagtatttatgtttaatttaacaacgtcgcaaccgttctgatacttaggggagttctgagtaagtaagttctagaaaggggagttccagtactcccctttctctcttttctgtgttaggtaaagccacccctcctaaagccactagcatggatccccaaaatgtccaccacagaacgaaaaggtaaaagaaggagaagttgttcctgttaaatcctgccgtatcacacgcaagagaaatggcttatcaacctgcctcaccccagtaaacacagcgcctaataaattcagtgcctaaactggaccccggacatatgaatctttgtccacagagttaccttcccccactgtttgtgcatattagagcaccgacagacttccattggtgtaacttaaaaaaaaaaaaatcctaacaaagtcctgataatcatctcagagaaagagtgaatgatatgagtatcaggtctgacaggagcaaactgtgaattaaagtaagagttataattaggatttgtcttttggtgaaagaatttgaccatcatcaataccgtgtaagttccagttgagcataggtgggctagataaaattgtgctgtgccttttactggtgatctgttcatctgtatgtaatgatagaaacgggggccagggcagataccaggtcttgaagtaggcttccatcctgtgactttgtatagatacttcctaaatccaacttgaaatttcataataggctctttcataaatatgtagccccattttatatcctctatttacatgtgtcccataaataattctccagaattatccgagacccactgattggcgcttcctagtcattcattccaattatcatgacttcagtctacggccataccaccgtgaacgcgcccaatatcgtccaaatatcatgacttcctttgataaccttagagccactaacacagcctgttgtcctcactagtatattcaactttaactgtggtggaaaatttggtctgttgagttttcttctgcttatttatgtagccaggccacagtgcgggaacctagcaaagtaatcccaatgcttgtatagcattgtttgcctctgcaagcaaatcagaaagactccactccaccaaatttattttggacatgcaggtgaagctgcagtttcccacacaaaccagcaaaacaggtggtcgtgaaattgcgattaacaacaactgcaatgtgtactctccttctcttttctctatcctttctggggagacacaggcagaataaaaatacagtgaaatctaattataattcagattccactcatacaaaattgttgcagttcaggccagagccaggtatgatgttttaaaagtgctaatctttctcttttcagtaatttttttaaagaaggaaatgttttcagctaacctcaaacattttatactgactttcatatatacatattttatatattaatggtaggtttatatgtatacatttaaatgaatctcctgaggtccttaattagattcagcattgactggtgctaattactgacagtacttgaaatttcttagttggtatttcaaagagaacatccaagacctcaactcttcagtaactgggtctggcttccagtttgtgtgaattaataaggctgaactaaaattaatttcctttggaaaacccgggggtggtcagaacagtctagcaccatactgcctgggggagacagctggtttgccacctgcaatgtctgtgacctcttaggcaagtgatttaacgcctctgtgcttcagtttcctcgtctgtaaaattctgttatactacctactccatagagttagcactcttaaatgcggtaaccttttggagtgtgtggcacatactaatcactatacacatttttctttttcaaatgaacaactaaaattcattaggtttgccctaatttcctttggccctgtatgaaattaagtaaacagtgcttacctgtacggactgcttaggctcttgcagtagtgtctatgattatggttttagtgaggaccttcttcattgtgaagtattaaatttcacgtgttgttagaaatgaaacacataaaatatattaaagagggatggggggccgggagcggtggctcatgctgtaatcccagcactttgggaggccaaggcgggcagatcacctgaggtcaggagttcgagaccagcctggccaacatggtgaaaccccgtctctactaaaaaaatacaaaaattagctgggcgtggtggtgggcgcctgcaatcccagctacttgggaggctgaggcaggagaatcgcttgaaccgggaggcggaggttgcagtgagctgaaatcatgccattgcactccagcctgggcaacaagagcaaaactccgtctcaaaaaaaaaaaaaaaaaaaaaaagtgaggtgagggtagcaaaagctcaagtctgtgtgctgtgggaggttatctggaggtaccaccatctcagtaatatgggcaatctcagagctccaggtctcatgaacagaacggtctcctgaaacatgcagatcaggagaactctgcagtggttggattctactgtcaggaagttgacccaagctcacccacctatcctgggtacttgagccttgcaggatcctaaggctgcaagccacgtggatgccaccatcatgtgaacactacaattatgagccctactgatagggccctactggtcatatcagcaccaagggctctaaaactttgaggtcatgtggcctctcttgtcatgttgctcctatggtcatgtgatgggcccagctcttccagtcactacagtatggtggactcctgaaccctgttgctcacatggattcttccctcacctggccattactggctaccagcatgtggaagtctcagccctcgaagtcatatagatgacctactgtttagggtcatgtggatgctatggtcatgtccactgctcccactcacccctccccatggccacagtgtcaggctcattcctctctgtcacgtgaagattgtgagctgccaaactctgcagatgtgtgtgtgggcagccaagtggctcctgtcatctcgtggcaggcaaagcctttgcggtcctgtgagcaccgcagctaaccaatggctgttgtacatgtggctcttatggtcacgtgagattccgcaccctcccattcacgtgaagattgagtgctccgaatcctgtcagagaggtgcttccggctccacaccctgactcaggcggaagttttattggacttcggctcagatctgaagccttccggcaactttcatatcctgacgcgctggaaggaagtctggtacgagtggaaccagccggtactagaagtttactgagaattgggctttaaggcgtggctgagcaatctccaaatagcagaggctctgagggggtggggtggggtggggtgggtggggggtgccgggggtgcgggagggtggggggtgcgggaggtgcgggagggtgggggggtggggagggtggggggtgcgggagggtcggggtgtatggggggtttgggtggaggtagcggaggacttccctaatgtggccgaacttgtgaacacctggcagagaaactgtgtgtgcgtgcgtgtgtgtgtgtgcgtgcgcacccatgcatctatgtctgccatccgccttgatcctggactcacaggagctgttgttggaggagaaggcactggggcagaatgtggggctgggggataggggtagggttggtagtggggcggcagggattcatgaactcgtaagtcgtttctcaggggcagggctgtggaagcctgatgggattccccccccttcccgcccccacactaaaagccctacccttgcctgtcactctgcccgattcaccgtctgtgccaggtgattctgtcctctgcccctcctcagaccatgttgttattaaggacactcgagactgcctagatcccagtttgtatagacgattccagacccaatcttaatttctgtctcttatttgattatgtaaagattctctttgtttccatgatttatttttctactaaaccttctaaacatgggctcaggggggtgggcgaaagggagagaggggaatcgggaatttttttaaaaagagaatttgatatttcaataaaagtgtccaagtcgtcatgatgtgaagattcagaatttacttgttatactttatttgaactccattggctttaaaaagtacatttgggagtgggtgacattttttttgtgtgtgtgtgcgcttaggatctctcagtagcttatagtagtatagcttcacactcttttgtttctgattctccccccatcaacccctgattttctaatgattgcttcttagattcctttctgaaaactctctccttttcttcctgtggaaaaaagtatagtgaatggatttaaggtacaatcatgggtgataacatttggtacatcatgaaagcggtattgggtgaatgaagttgagcaaatagcaagattgtgcttaaacttacggggtttcaaatattgcttgtcagatggttagagaatattgtcacttgtgatatttgatattacatgtaggttgaataatctatttttctctcatttcagcatttccaagttcgttctgtgagactgtagtgtcaggacaaagcaacaacaaaatgtgctctactctaaagaagtgtgggacatacagaactgaaggtaaacgaatactgtaggatttttttagatgatatgctaataaacaacacgagtctcaaagggggggctactttccccaacttgtatgggaatggaacatttttttccacagagcatttgaggtaccagtgttcttcagaaaatatttggggaaaccctgttcagactacatcttctaacactttaaaaccttgtgcctttgtttactcagaacaatggaatgtgggtttataatagttgtaatctagtctgctcattaagacattgattgttgctctttaattcattttatctcatgtcatcagtcagtctctcctgcttgaatctttgtacttttttactcttcagagataccgccaagcatgcatctgataccatggtggtggcagacaatatgtgcataaatgcaagtcattaggaagccttacctgtggcagcaaataaagtgcccccactcttgaaaacaaggtacaacttacctgtcaggacaagcagatgcagtaccgctcattttacacaataaaaaaccacacttcttcagaaccattttattattacttaataattacagctgccatagtttgagcccctgtcatatgtcaagcactgtgataacctcggctgtcatgcaagttactgcatttaaccctcaggaaagtcctgagagggtgttatcttaattgacagatgagatatatgagtcaggagaggctgagtgtaacgctgtgcttataggcaacccccaaacctcagtgacttatttctcactcctgctgcatgtttatgccaggtgcatatccttcacgggatggtggatgttgggttctgagccattcttattggaatgactcagagacccaaactaatggagcagccaccatctagaaaggggttactcactgcgtcagagtgggagagagccgtagagggtctcaaaccaacaaccaaaggttctgacccagaaataacccgtgtcactcgtcactcacaacccattggccagagctagtcacatgcacggccctgccccaaggaaggcagtcgggtcgggcagtcctaccaggtgcctggtacaggggagaatgtaaacacttggtaaatggcagcactgactactgcatgaaggaatcaaagctgggagggattaagtacttgcctaacatcacatcggccgtaagtgacagaatcaggatttgaatccacccaggcgtgatttcaaagtcgatgtcctttctgcttctttctacgctgcctgctcttctcttaaaggaagcttatagtaaaaattcttttacatcaatgatgcaatgccctcttccttaatcatctgatagtttaattgaatagacacgatggcactggttaaaaagaccagcactgataagccagaggtcttttccaaatgagggaatgtattggatatttgaatatccattgtattcaattataaaaataaaaccaggtggtagatgaaaggacttttcattgatcatttacttaatgtggaataatccccatgtcttaccgctatgttgaggaaaaatgataaaaaaatagagcctaccttgatgaaagtgaaaacaccatgtgagagagttgaacaaaattgctagatgtcagtgtttcagaagcgcaggataatgataaaatctctggccacacgggcagagaaaattagcgaggtggtgcgggtcagccacttttggaatgaagatagtgtcacacttacagtgacagaaaagattgaaaaagatcacattatgaaaaggatgtgaaaatttgaaaatttagattaaattgatgaattccaggggaaaaatatatataactttccaaactgaaggaatagaaaaccttggtttattcaatgtattcttgacaaggaatacatgcaaaggcaaaattactagccaacccgaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatcaagcgtatgtgccaacatgagactcagaggtggaactgaataacatgggagccatatgtggggtggactacccgtgatgagggaggtctccagttttcatgcggcagccattgcagagtttctagaattcagtctctgtcatgcatgtcaattaacgggcaggcagcagtggtatttcagctgtagcagttccatcacgtgggtggacttctcctggctgtgcagcatccaggcctgcttttctggccctcacagagtttttgtaagctatgtaatatattttattagagatatcttgtttgtataaaagagctagagtgaattctggcataggcaagttgggaccttgattaacagagtacttggcagcaaaattggttgcaagcaaaagaccttgaaggaaatggggatctggggtagatttggcccacagggcatagttgctgacctctaagctaataagttgctgacctctaagctaatagactcactgggtccccaaaacagtgctgagtgggaagtcagcaaaatgaggaggcagctattgctaggatcctctggcaagcataagccaaaaactgaggctttaacacggttgttttcaaccttggttgcacactgcaattcacatggagagttaaaaaatgtggttgcctggatctaaccacggttctgctttgattgttttgggtgtgtcctggtgctagtgaattgtttcagtgtccccaagtggctctaatgtgtaatcatggttgagaactgcttgaacaatttaaatcataagaatgcaagcctttcacaatatttaattttaaaattttataattgtggtttcagaatgataatattacagtaataataaatacatagttacgctggaaaatatgaaataaagattcccatgtaagacatcgagaagattgtctttttcaaagagaaaggaaatgggaaaacacagtggtaaagccggggccaccacaggttgtgtccggcttgaagctaaactgccggcaaggccagagcaaggtatggattaaagctaagtgtctgtgagcccagggctgattcagcagtggagcttcctctgcagaagacatccacaacccaggatcagcaaggaagggatggcacaaactcaacaaatccaataattggcactgagggaacagaaagaatggaagaggctgaaacagacattaagataatatttccccagagagacaaaggagtgataaaggatgaaattgtgtctattacgaaagaatagaagactgcccaagaaagatggctttttgaaggcaaggatctcctttcacttcctcctgaaacttcattaaaacaacatcaaaggtgaacaaattatggtatatccatcaaggggcttttactcagcaaggaaaagtcaagaacatggatgggtctcagaaacattatgccgagttaaagaagccagacccaaaggggtgcagcatgcacaagtccatttgtgtgaaatcctagaacaggaagatgaatatatagtaacggaaagtatatcaatgtttgcacggagccaagggatgaagaggagatcgactggaaaccttttgggttgtgttatatgttctatatcttgattgaggtggtagctagccctaatctctgatttttacatgtaaggaacctgggatcaggagaagttgaatgagtcgtcaaaagtgaggttagcttattaatcagagagaagatattcacacttgattgtcagtaataaacggtttccattatgctgtatatgggtcgataggaaaagtgcttctccccaagcacttgacaaaaccctgacccggccataaacatcctcttatacaagtatgaagcgtaggtgtgaaagtataaccattctgcattccagccacctacttctacacatggttgacattctcacgtgtccctttaccctgacttgtttgtgtttatatttacaaatgaaaacataacttctcattaatattttcttctgaggaatcatactgtaatatacagttttataacctgactttgtttttctttccctttgtatcacgtggcgtgacgagtattctaccttgttgcttatagtctgccacttaaacctgaaacatttcttgcataataatacatttttttttcctgaaagatcggaaacgggaacttaagctccctactgaatccttccgcataacctgtttcatgctctgagctttctgttttggttccctgaacccatatgtcagatgattctccactggagccggggctgccctgttttactactgccgctttgtaagatacattaatagctgacatggcaaccagatgccactcactcatctcttttccttgtcatttccaggaggactaataacaacgaatgcaactaacacgtatttctccctcaataaacgccagatgttgtactacgttctcgacatagtaatagacaacttatttatagtgcttgttaggtcacgggcatttctccaggtgcttttcacgtgtttccatgtgttaactcacttaatttttacagtagcccatgaggtagaaactgttactatctttgagttagggggaaaacaagcaaaaagaacttgagtcacagcgaggtcacttagttgccttggatcatagaatttagcaccaggattgaaatcctgatggatctgaccacaaatcctaggcccataaccaataatgtgcgactctgtgtcaaggctgaaatgagcagtacgacagggcccactcaaagtctgctgggcaatgatgggtgtggtttctggaaccaatgtcccgactccagccttctgtccaagagactcatcattgcacagtgttgccctataccatctctccttttttcggactgtgtgggaactgtttctctggtgttcaacttgaagtgaagtaacagggacagacaagatgtacatggacaggaaggaaggagggttttcagaggggagcatatcgccaggatgaattcagttccctggaggcgttttcaatgtgtgtttctttgtcttctctgtactcaccctcttctttctgacccacacatccatcccttggccttttcaccctgtatgtcaggtactcatgccccttccttgccatgtctacttcattgcaagggcagtcatttctacttctccctttgacaatatcagccactctctggtcccgtcatccttctgtcccaaaggacctgtaaagcacagccgtataattatatgtatatatttagacagagagtgatatatgtaataaattcgaaaagtgaaacgtctggatcaaagtgtaagaatgacttctgaatggttaggcatattgcagaaaattagactcacacacggttagtggaagtgtatattggtgtaaatatcattgaaaatccttacgaaaatatcactttatgcttaaaagtactcatgtgcttctcctgggaaactgtagagcagggactcaaaatcttaaacccacttcgaagccctggctgtgttccactgggttttttggccacccctgctgggggtactctgtaaccctggtcaacctgtgggtattgttccattacttttgtgtacagggaactctcctactttcttattttaaaactatcagttcaaatattaaaacaccgagaggtagaaaagaaaaaaagcactaaaaagcatattctgaacaagaaacaaaatttggccatatataatacataacacatgaaaagaaatgtgcagtgggatccagtgttgtgtggcaatgtgtttaccaacatgatttggagtacatgtatctgtaacctaattgtggaagcatgtaatacgaaacactaatacttgctcgcatgggcaacacggacacacagaccacacattcttccctttctctgagacagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggaggtactcagttctatttctaaggatacattaatgaaaaaatattaatgttgcagaagaaaagattaatttgttctagttttgcagtcaggttatgaaatagttctgcagcccgaatagctctggaataaatataaatagaggtcggtagaaatggttcagatggatgtattctcaaaagtggttttgtcgatgatcccaaacctacatcaaatgcattcatttaacaaatattaattaggcccttattctatgccagacactaccagcccaaagtgactcctaatctgaaaacccatggcccaaacagattacacccatctggtccaagacagagatctccaccttatccaagacacctggttcccaccccaacaggagtgactagcacaaaacatcatcccggcctgcttacaaaaaaatctgtcgatgagacctgaaagcttgccatttaagggagaaccagtgcagtctctggaggagcactcagggtatagaggcagaccaatatacgtgaggacataattcctgttctgccacttacctggctgggaaatgtacccgacatctgttaacccaatattcatgatctgaaaagggactgtggataaaattctcatgggatttctgtgaggaggtcaagagaaacctagtgagtctgcccaacactgagcagatgttggttgccactgggcaagggttggttttcttcttatcccgttctttccctgccgtagcagggatgctgatgccatgcactcagtggcatggcagtgatgtaggcagaattccaaactaacacaggaagtaccagtaggaacacacgtgatgtcataaaggttactcaccactatgtctgtgtggggggatcagccagtacatggtgggacttgaggggaaacccaggcggtctgggtgagaagtactagctgctttataatactcttgagatcgcccgtaattctggcagcacaactgcgagacagggattgtgctgagatgccagagttcagcaagtggatgtacgcctgtgtgtgttgtgtcttcggcatctctctctgtccggtccctctgtggctttttatcacatgtgctctcttccaacacaaggccttgcctgaggctgtagctgtagctgttggctagcttacacttttacaccttcttcccctcagtgacgttatttctgaagtaatgtgtgttctcaaaaatgactctgactcttcctgtgctccatatattgaccgtgtgcccttaaccctcactttaatctttgatttttttccctttcatttatggactttcatgaaaatgagttggtttctggacatcctccaaatgtcaccaataggggtctttgttgttgttgttgctgttgttgagtattgttatggactcataactttttaacatactgatgggctccaaaccgcggttaaaggattttgagtaaaggaatgacaagatttgacttatgccttaaaaaatcactctgcctcctgtgttgaaaatagatggtaggggagtcaagggcaaaagcaggacaacttggaaggcagcataatccaggagacagatgttggtgacctggccagggtaggtagcaatggagggggtgagaagtggccagactctggatatattttaaaggtagagccaagagaagatacatccatcctgatcggttggatgtagagtgtgagagaaagagagcactccagccccacttccaagttgtagggaccaagcatcaggaatgtctaggtcagatgctctgcccacatttaatttcacttctaatggcacacagggaaagtcccagcaatcgagaggagcaggactgtcctgacagcgggtcacacacagtgaaagcaatgatgccccctacagaagttcatctgaggcctggccataatcagtatattgcagagaggtcagcagtgaccgaaattttattcataagagtgccctgagacaaggtgtacattttgaaattggtcgaggtctgtttgatggtccaggagatggtctaccttcgtgaatgctgcaagacagtagagggggaaaaaacatacatgctctgtttttgttgttgggtacagtgtgttgggtacggtgttttatttatgtcatttagatcctgttactgtagtggttttcagtatctgctgattttctttccagtaattctgtcacttgcttaggaagagttgtctcttgggctgaaagcatttcgggctgggcaaaaagaaagcttgctctgggtatttcaaactgagtatttttgagggcaaggctggaggcaggagggcagcttgggaagctgttacatcggacccacctgtcattaaagctcgtactgcactggcaaagaggtatagcttgctgattgttcacagaatgcatttggggattggatttgggaggtgcgagagagcttgtctcccaggtgttggtgtggttgttagattagagaagcctgagagaaggcaagattaggaccccttccaggtgtgtggctggtgtctagtctaacccatggacacgcgcacctctgttctttataattcctgctccatttctcaggaggttcaacacagttgcttcctctcccaagattcctaccctgattgtgccacctgtgagataaggctcttgtatctggacaggcagaggagtttgttttctggggcttatgtggcgggttggcactttgctagccctaccatggagttagctcacgacgtggtacgtggtaagtggaccattgatgtgtctcaaacttgtctttttgttctcagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacagtgagtatcttggtggggtctgcattaggtggactattctggaacctgatagaaggaagaccacttaaaacaccctaagttgattatttggaggagagcttcggaatggggggaaagggagtttagggcatctatatttggcacaaaaataagaaatcatgtcagcggtcctttctttagaaatctaagctaagtagaaggttggaaagaaagaaaaaaaaaacccagctggttggttctgttctccatccttagttccacgttgtctctcccttccctcctatttcttctttttacccttagattccttacgggataaagtatgacaaggcatggctaatgaattcaatccagagccattgcagtgaccgcttcactccggttgatgtaagagaggatggtgaagccagatgagtgggcatgggggacggggagaggcctggctcagcaggggccattggcctctgacgctgttgctcttgccttcactccctgtagttccactacgtccgaaatcgggcatgcttctttgtccaggatgctagcgctgcctccgcattgaaggatgtcagttataagatttatgatgatgagaaccaaaaggtgtgtgccgagggcatgccctgtacttagtctctgggcaggaggacaggccagggggctggtcatcctctttgggattagaggtcctggtacttaccaccctgccttcctgcagatatgtatatttgtcaatcattctactgcgccctactctgtgaagaataagttgaagccaggccaaatggagatgctaaaggtaatacagactcaaggatcattgtatgtccacttcctggacccacctcttcttcccctggccccctctttccctgtcaccacaccaccaccaccaccaccatcaccagagccccagagcctctgtcttcatctctatctctgcagctgaccatgaacaaacggtacaatgtctcccagcaagctcttgatctccagaatctccgctttgacccaggtaaggctgacagcagcaattctaagacaagcgggggcagagaggtctgcctgggagggagacttaggaatggcaatttacagaggggttggggctggctctggtccagccagggccctcccagccttccgattcccttctcttggcttcttcaagacttgatgggccgtgacattgatataatcctgaatcgaagaaactgcatggctgccaccctgaagatcattgaaagaaatttccctgaggtgaagccttaggctcagtgctggtatttagttagaggggtggaagggataaggtggagggcagatttgtctctgaggcccaagatagtagccgccactctaactcttcttgacccaaagctgttgtctttgaacttgtgcaacaacaagctgtaccagctggatggcctttctgacattacagagaaggctcccaaagtcaagaccctgaatctctccaaaaataaggtgagaagggggagccagatcaactttgggtggagggcaggacacatcaggataatggcaacagccaggcagtggcacctgtgggtgactatgagggccgggggaattcagggcccagggtcctgggtgtctctctttccctggccctccttctccagtttcctccccatctttcttagctggagtcggcgtgggagttgggcaaggtgaaagggctgaagctcgaagagctatggctagaagggaacccgttgtgcagcaccttctcggaccagtccgcctatgtaaggtcagtggcaaccccggtcacccttcctgggcacctttgctccctgggtgactgagctgtgtctgaaggtgcccttctgcaggaagaagcagccttggtcctctgggaggaccacagacctcccttcctactctctctctctctctctctctcctctctctctgtcactcactcatctgtgcttagaggtctcctttccttcctctgacatggtccccttttcacctgctctggggtgtgtttcccgcctgtctccaccaagcctcctccagtgtgccctctgtgagtgtgctccaggaagtggggctcccccacctccccaggaccagcagtattcagatgctggtgccctggaccgagaagagtcctttagtccggggcttcatgctgagacaggccttcctgcctccatgctgcgatggggcttccctcccctgtcccaagaggggttctccttctcttgctccaaaaaggtccccccacctgtcctgggctggcatgggggcttccctgccccatactgagggctggggccccgggtggctgctgtcatgccatctcttcctctggcccaatgccaggagctgggccctccttggggagaaacctgggtttcctacgtcaaggggccagaagcgggccacgttcctgaggcaggagtggaaggcagagggcagaggaggttgagaagacagaaggacaggcctctcaggcactgccccaccttccctccttctccacctcacatcgtcctgcctgggccctcagaggagccctgggtagcccgagatgggtagcattcctcggtcaaggcgtcagcacagaggggcacaggagtcagggaccatcagaagagaatgcagtggtctggagagggggtccccagactctgaaccccatgctgagctggggcctgactcttcactcctcccgggagaaggtctcctgtccccgtggctgctctgtttcccatgcccagctcagactgagctcacacaggtgaggaaggctccagctgcatccagtgggccccagcccaacaggcgcatgttttcctttcctgcctcggtccccagggccagccagggagcagtgagggaaagggctgcagcaggggagcccttttctcctcttctcctccctgaactccacctccgcagtagagagtctttcccttccctttgcattgcatcctgtttctcccttgtctctcctctcctatgtctcacccatccgtccctcccctaccttcaccccgtttctgttgttgtcccccctgccttccgcttcctgcctcctgagtccggcctcactcacctccgtgtcccagcatcctgggccatccctaagggctgacctggtcttggccagggcctggtcaggcaggttgatggacagccagtgaggtggcagagccctgggctcccaccccatttcctgctccctgcagagccttccatggtgacttgggcaaaggggagggagggagaggaagaaagccctggagcctgggctcccagtgctgcttcttgtagcactggagaaaagggagtcaggacagtctagatggaagctaaccaggaggaaggagagggaggagtgtgagagggagtgggagagagactgtgcaaccctgaactgtcagtcacttcattcaatttttggttttggacagtgccatccgggattgtttccccaagttgttacgcctggtaagtatgtataataccgtcatcattgtctcctcttactcaagaaaaggacctccacgcctgccctcaagtcctttgggtcttgcctagattacatgcttgtatcagaccctcatccattttacaggcatggattcctgaaaaagacaagaatattctccctggaaaatgtgtccccccgccgccaccccccccccacacacacatttgcatgtgatagtagagatgtccagcaccccatgagaaagccacccactggaatttccagggccatttcccacctagcctctgatgcttgtctccctgggcatgttcatcttatcgatcatccagctccatctccttggtctccactgctgacttcctctttccttctccaggacggccgagagttatccgcaccagtgattgttgacattgacagctctgagacaatgaaaccctgcaaggtgaggaagaaggaccaagcaagatttgggttgctgtaagggaggctttgtccaccgcatagatccaaattgtcttttgatttcaggaaaactttactggatctgagaccctaaagcatttagtcctgcaattcctgcagcagtgagtatccctgggaccatgaggaaggggagggctgagacaggctgggccacccgtgcagcctgggagttttcaagtctcatctggggcccaggccacagagatagcctatcctcactgcttccccacaggtattactcgatctatgactctggagatcgacagggtctcctcggtgcttaccacgatgaggcctgcttctccttggctattcccttcgaccccaaggactcagccccgtgagtatcacggctcagaccctgctctggggctgtgtgtctccccagcagacacaggccaactcctggaaatgcccacactggccggaccacccactcctgctcctctttttctcctaggagcagcttgtgcaagtactttgaggatagcaggaatatgaaaacactcaaggacccctgtaagtgtgtgatggggaagagtgggcaaggtaagggggtgtgatgggaacaatcacaggggccaaggaccaggatgtggtagccccccgccctgccccgcccaccctgccattccttgcttctcctctcctctacagacctgaagggggaactgctgaggcgcacaaaacgtgacattgtggactccctcagtgcgttgcccaaaactcagcatgacctcagctccatcctggtggacgtgtggtgccagacggtgagcacctgcttcctcccttgggcaggcccagagagccagaggtgggtaggaggttaaggaggatcctgagcacctgagcgcttccttttcaggaaaggatgctctgcttttctgtcaatggggttttcaaggaaggtgagtgtctgtatagtcccctccccagatcccccactgctccctccccctggctgggctccctctcagaactcccccagcttccctgctttcgttcctttcctttccttcctcttctttcttccgtgttttcccacccccactctgccttcaaaccaccctgatctgacctaggtccatgcctgtctgccctgcacagctcaggcgtgcgttaaggacacagactgtggagtttgacagctctcatcccaggtccttactctgtgaacttgtgctggttacttaacccttcagtttcctcatttgcaaaatggggctaataatctatctcttgggctactgtgaaataggaattaagtgaacttgtggttttcccagggccccacacatgataggggccctgtcactgggagcggattgttcctgttgctgccctccccattcctgccacatccgcctgactccaagtgaacaattgtcctggtctgccccctcccccccttctgtgtgagtgtcaagcaatactctgactggggatcaccgtgtgagcatgttaaagcctgtgcaactctaaggtggtggtgtttgttgtctttgaagtggaaggacagtctcagggttctgttctcgccttcacccggaccttcattgctacccctggcagcagttccaggttagtgctgtgttgtgggtgggagcacccatccaagcttggggccagtgttgtggaaatgtggtgggtgcagtcctccgggtgttctcaatattgtggaaggccgacaggaagatccaaggagcagtctagcctagtgtttaagagtgtgggccctggagtcagaatacagattctgttcctcactccaacactcacaaactgtgtgaccttgatcaacttattcgaccactctgtgattcagtgcctttttctgaaaattggaataagactatccacttccttgggctgttgtacagggtaaatgcgttggggttggatctaaaaatctagtgaagctggtagacagtccctccaaaggtggactctgtgggagggttagagggtaccagccaaaaaatctgggaggcaggcacagttagggatatggaaggaatttggttgttgagtggcagtggttaagaaggatcctgttgttgggggtgcggagttatctacttgtccagtttgagggtgcatttttctttcctccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgagtgctgggagtacatggggatgggggctgttgggacatcagaggaatgagtaatggaaactcacatgcaatttggaaaaataactatctgggtattttgcttccaaaaaaagtgggtccatgaaaaaggtatcatacttttatactggtatatgtaaatatttttttaaatggcataatgcccaaatgacattaccttccatttgtaaaatctgaaagaatcaaccacaataaactactgataaaccaggtcagcaaggttgaaagatacaatatacaaaaatcatttgtacttctatgtagttgcaatggacaatccaaaaaaatgaaattaagaaaataagtccatctacagtagcatcgaaaagaagaaagtatgtaggaacaaaattaagagaagaagcgcaaatcttgtactctgaaatctgcaaaacattgctgaaaaaaattaaagaagacctaaatacgtggaaaggcatcccacgttcatagattggaagacttaatatcattacgatggcagtaccacccagaacaatctacagattcattgcagtccctgacagaatcccaactgacttctttgcagaaattgacaaggtaatcccaaaattcatgtggaaatgcagtggaccccaaacagccaaaaccatcttgaaagagaagaacaacgttagaagactcacacttcccgatttcagaacttgctacaaaactacattaatcaagactgtatggtaccgacataggaacagacgtgggaatcaatggaatataattgagagtccacagataatctcacgtatttatgtccagttgattatcattcagggtgctgaaaaaatccaatggagaaaaaaaatagtcttcttaacaaatggtgctgggagaagtggatatccacttgcaaaacaattaattttgacccctaactcacatcacgtgcaaacactggcagaaaatggatcaatgacctaaaataagagccagaactgtaaaacactgtaagtgtacatcttcattaccttgaattaggcaaccatttcttacatatgaaaccaaaagcacaagcaaccaaagaaaaaataggtaaattggacttcatctaaattaaaagcttttgtgcatcagcagacactatcaagaaagcggaaaaccgactggtgggaacaagggaaaatatttgcaaatcacatcgccgacaagaagaacccttacaactcaacaacaaacagacaagccaccgaattaaaaaatggggaaatgatttgaatagatgtttctccaaaggagatatacaaatgaccaagaagcacgtgaaaatcttctcaacatcgttagtcattagggaaacgcatatcgaaaccacagtgagttaccacttcatacccactacgctagctttagtccataaaaggaaacatgacaaatgtcggtgagaatgcagagaaattggaaatctcatgtattactactgggaacataaagtggagcagttgctggcaaaaagattttggcagttcctcaaaatcttaaacatggagttaccacatgatccagtaatcccactcctaagtgtataccaaaagaaatgaaaatatatgcccattcaacaacttgcacatgaatttccgtagtggcattattccaaatagccaaaaaatggaaacacatggattgaccttcagctgatgaatggataatgtggtacatccatacggtggaatattattagaatattattcatccacaaaaaaggatgtagttgtgatatatgctatgacgtggatgaaccctgaaaacattatgtgctaagtgggagcacccagtcacaaaaagccacataattatatgattccattcatacgaagtgttcagaatagccagatccgtagagaccgaaagcagagtagtggttgccaagatctggggaagagggagaacagggagtgatctctaacagttaaggagtttctttttgaggtgataaaaacagtttggaattagataggtgtgatggttgcacaatcttgtgaatagacttaaaagcactgaattgtacaccttaaaatggtgactgctacagtatgtgcattatatctcaatagaaaagaaacgtattattgaatttccacttgttatttcttgaacatctttctttatcaatatgtattaagctcccttgttcatttgaataccgctatgtttctgatttgaattctagtgggcattaatgtcagggatgggcgttttggttttccccaggccttttttcattgttacaatagtgctcatattggtacatgtgacccagcaaaaaggtagcatagattaagggtggcattgcatagtcagcgtgtctgtcctgggctagtaatggagagcacctgttcttctcccaccccaggtgccttcaggacaatgagtggaactacactagagctggccaggccttcactatgctccaggtgaggtctgggaatcaagtgggtaaaagacagctgtctctgggtcgtcaggagggccaagaagatggaggccaggtagtgtggggatggaacccagtgcacctggctctactaacatcccaactccttttctttactttctctagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 4807 - DNA, 3108 bp, human
ggcggggcctgctgggtggcttagcactgcagggctctgcgcgggaacgctaacctggtccggagcgagtctgggtctcagccccgcgaacagcctttcacgagtcttcaagctttcaggtgaggacctgcggcctcgcaggagccagaggaccatggggatgggaaggcgtcagggttgcgaggcgggggatgccgcgccttcgggagccagaggagccgaggttggggctggcgcttcgcgtctgcaccgccgcccgggcgagcgagtccgcgcctttgtcttccagggggccgccttctgcgctcgatgccgagccctcctgggggccggtccctggaaacaaggccccggggttgggaggcggggagcgcggacccttaaagggacctgtccgcagtagctgcaggtcggaggcttagaggatgaggagtttggaggccgcccggaatgggccccctggggcttggtcctcattccttctcctcccgtggccgttaggctgggcgccagaaaaagctaatagttatttttaaaagtatgcaaactgctcttgacagactggcctacgcacccggccctgctattatttatttgttagttccagttttccagctctgagcttggcgtctaatggcttggcagaggagggtcttagggtaaactcgacggaatggaggcatgttcggcacttctggctgcttgggggcctctccattctaccccaagcactagacatagtatcttactgcacgagggtggggctgggcttgcgaatgagaactctgccctccgatttctgggatatcctattgtctcttctggacaaactcgggacgcttacagggcaccaggcatttcgtcaggtccacagccatgcacctctaagcctcatctctttacctctctctttgcagagaaaacatggtgaaacaagactcgcttttatttggtttatcccattctgctgaagtcctgggtttgatcctagttagctgtcccttcttacaacgtttatacaccaatgccacaaggagctattatgagacgtgtattgtaatgccttaatgtactgtcatctttgggcatttaaaatagaaagaaattagtacaacttatgccactctttttttttttgtgctgctccccgtctcctaaaaaaaaatgccaaaaaacaaaagtaatttaatagaaagtgaagatgctcgaatagtgctatctcctgttacaaaatcattaactggttaaagccagtctttattttttattctgtccctgtctgctcttgtgcttctatcacctccattttacccttgctgtgattttaagagtcagacatattggctctgggtttctggagaatcttggtttctggtgcgttctgatccaacggcatttactgcatatcaaaatgggctaatgatgtggagttaaaattattctaacaaaaatataacttttctaagatctgttgctgtttttctgttgaaaatgagcgggtagaatatacattgatatgaaatatgaaaatttttgcttgtgaccccttagtccgaagacagttctgccaggtaagttttcttaaaaatgtttattcttttcaggctatcttctagtcaagatgagtgataagccagacttgtcggaagtggagaagtttgacaggtcaaaactgaagaaaactaatactgaagaaaaaaatactcttccctcaaaggaaagtaagtcatggggggttctagtggaaacacacagtagagaaagttaataggttcagtaaataaacctatcttctagtaaatttttgccacaaagtaagcaataattagagtaccatggtgtttaatgtaacagttaaaaacatcaaatagtcatcttcctacttgggttatataagtagttctcacataagtcttaataggaatgggggggaaaactagtttcttgttggaaaattactaaaaaccaccttaaaaatcaatcttggaatattggatttagcactagaaaaatcttagttttgttcactttatgcttattagacatttttctgcatccatcagtttgggtcagtggtcttatacctaaagatccatgcaaactttgcagttttggccttctctacctgatgatgagataaagacaatgaacaagtttagatcttgggtgcacgtagggctcacagactcaagggataagtgatcagttttgccctccagaaatacagccttctggagaaactccaagtgtttttgcaaaagttgaggggaactttttgtcttgttagctttgagagttccaaagttagtcaaaattgtctgaaaaggtataacttcctagttgtatatggatagataaatccgaagaaattgcttcgtatctcagtcttgaatcatctaagaaaaaatggcaacagcatgtctctatctcttaaatgggagaaaatcctccacagttatagattgtagtgaatattcaggtagttaacacacacacatacatgcacacaccctaatgtgaggatttgtggttaatgccttggcattctaaatttaaggcatgtatgcagacttcgatgacttagcaaggagctcttttgaaagaaactgaacttaatcttaggtacatacggttaatgatttttgtgtttgtcttcccagctatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatcttg

SEQ ID NO: 4808 - DNA, 3181 bp, human; identical to SEQ ID NO: 3524

SEQ ID NO: 4809 - DNA, 1263 bp, human; identical to SEQ ID NO: 3525

SEQ ID NO: 4810 - DNA, 1505 bp, human; identical to SEQ ID NO: 3526

SEQ ID NO: 4811 - DNA, 1700 bp, human; identical to SEQ ID NO: 3527

SEQ ID NO: 4812 - DNA, 1601 bp, human; identical to SEQ ID NO: 3528

SEQ ID NO: 4813 - DNA, 2130 bp, human; identical to SEQ ID NO: 3529

SEQ ID NO: 4814 - DNA, 1859 bp, human; identical to SEQ ID NO: 3530

SEQ ID NO: 4815 - DNA, 1234 bp, human
ttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatg

SEQ ID NO: 4816 - DNA, 994 bp, human
acgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgg

SEQ ID NO: 4817 - DNA, 1382 bp, human
cagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcaga

SEQ ID NO: 4818 - DNA, 927 bp, human
gcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaa

SEQ ID NO: 4819 - DNA, 1247 bp, human
ctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaag

SEQ ID NO: 4820 - DNA, 1421 bp, human
gtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagg

SEQ ID NO: 4821 - DNA, 2216 bp, human
tgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaa

SEQ ID NO: 4822 - DNA, 2026 bp, human
ggctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaa

SEQ ID NO: 4823 - DNA, 2161 bp, human
caccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttcttta

SEQ ID NO: 4824 - DNA, 1963 bp, human
gcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggc

SEQ ID NO: 4825 - DNA, 1987 bp, human
cacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacac

SEQ ID NO: 4826 - DNA, 11287 bp, human
tggtctaagacatgggctgacaaactttttccataaagggccagaaagtaaatatttcaggctttgtgggatatctatttatgatttattttactcctagtattatttcatcttttatacaggttattaaggttagtattgctgcataacaaattactccaaaatttaatcatttatattcaagaagagttcagctgctaggttcttattttgggactctcatgatgctgaggtcaagatgccagctggaggccaggcgccgcagctcacgcctgtaatcccagcgttttgggaggccagggtgagtagatcacctgaggtcaggagtttgaggccagcctggccaacatggtgaaaccccgtctctgctaaaaatataaaaattagcctggtgtggtggcatgcccctataatcccagctactcaggaggctgaagcaggagaatcgtttgaacccaggaggtggaggttgcagtgagctgatattgcaccactgcactccagcctgggtgacagagcgagactgtctcaatcaatcaatcagtcaataaaatatgtcatctaggacagcaatcatctttaagttggactaggatggaaatccaagagggctcactaagagggatggcagttattgctggcttttggattacaacacagctggagctgtcaatcaaagagcaaatatatggccttttcagcatggtggtttcagggtaggaagaattgttacatggcagctgcttctccaagagtgaatattccaaaaatgccaggcagatctttgtggggtgttttgacctaacctcaaaagtcacacaaagtgatttacactgtattatactgatcaaaatagtcgcagggcctcccaaattcaaaaggaagagacaaagtccacatctgtcaatgcgaagaatggaaaggtcacatatcatatgtggagcgggacataacaacttcggaaattaaatctcttccccaggtaaataaatggatgcaatatgcatatagatattcaatagatcaatgttgttaatagtaaaagtatggaacatttctaatgctaatcaatggagaattgattaaataaactttggtaactctaaagagtagaatattatgcaaccattaaaatgtataaggtagtcctatgtagactgacatgggaatgttctgaagatatagttttaagtgaaagaatcaagtagcagaacagtatatacagtacaatttcattaaatatacaaattgtatatgaaataagcatagaaaaatttagtaaaatatagcatacaaccccaccctctacattatatgtatgtttgattttctgtagtttttataattaacaacatagtaaacatttagctacatatatcaataaatcttaaaattctcataacttttgatccattaattcaagttcttagaataaatccaaataaaataatcaaggaaatgtactaacatataaatattaaaacatgcataatagagaaaaattatgtgactttaattcaatccattatagtgaaaatctgcatatataatactttgaaataatcaatattatgacagatttttatcacagctttattgagatataattctcatgccatataattcgcctatttagggtgcataatccaatggttttttaatatactcacagagttgtgcaaccatcatcacaatcaaccttagaacattttcatcacctcaaaaagaaatctcatgcccattagcagtcactaacattttcccttcaatttcccacccctagccctatgctactactaatttaccttctgtctctatggatataccaattctaaatgttgcatattaatggactaatacaatatgtaataatttgtgactggattatttcacttggcacaaggttttcaaggttcattcatgttttagcatgtatcagcactttgttccatttttttgccaaataatattccattgtacagacataccatattttatatatctattcattgagtgataggtatttaagatatttctactttctaactataatgaataatgctgccaggaacatacacattcaagttttgtgtaggcatattgtttcatttgccttggggatatacttaggagtggattgttgcgtcataaggtaatgccatgtttaacattttgaggaactgcccaactgttttccacagtagtgtgccatttgatgttcccacctatagtatgtgatgtttccaatttctctacatttttgcaaacacctgtcattatatttcttgtttattatatccatcctagtgggtataaagtggtatctcattatggctttgatttgcattttcctgatggctaatgatgttgggcacattttcatgtatttattggccatttgtatattttctttggagaaatacctattcagatcctttgcccattttaaaattgggtttttaaaattatttagttgtaagtattctctatgtattatagatacaagtcccttatcagatacattactcgcaaaaatttttcctattctgttagttgtcttctcactttcctgatgatgtcctttgaatcataaaaattgtgcattttgatggagcctcatttatctatatttcttttgtttcttgagcttttgttgtcatatctaaaaaaccattgcctaatccaaggtcataaagaattacacctaagttttcttctaagaatttgatagttttagctcttacaattaggactttaatctattttgaattgttttgtagatggtgtgaaaaagaggcccaaattcattttttctgcaggtagatatccatttgtctcagcaccatttgttaaaaagactattctttcatagttgaattttcttggcacaactgtaggtatgagggcttatttctggactctcaattatattccattgatctatatgtccttatgccagtaccacactgccttgatagaaatctggaagtgtgagacctccaatgttttccttttttttaaatattgttttgtatattctgggtttcctgcattttcatgtggattttgggatcagcttaccaatttctgcaaagaagccagataagattttgatagagattacactgattctatggatcaattttggaaatactaagtcttcagatctatgaatatagaatggttttccatttatttaggtattcttttatttctttcaacaattttttttagtttttggtgtacaagtcttggaccttttattgaatttatttctaagtgttttattatctttatgctattttaagtggaattgttttcttactttcctctttgaatagttcattgctagcacataaaatacaattaatttttgtatatcaatcatatattcagccacattgctgaactcatttgttagttcctacagttctttagtgaattatttgggatgttctatatgcaagatcacatcacctgcaaatagatagttttacttctttcctttcaacccggatgccttttatttcatgtctcttgcccaccctgaagatatctgaatgtatgtcagaaaataaagctcttcattttccctcaaatatttaactaattatacaaatatagtttctataatagcctattttttactactgatcagaaatgtttccctatcacacactaaaaacttgtatatttgggtgtgttagtgggctttcttgttttatttctcttattgtgcttatttcagtactatattggttaaaattgtagccttataagtcattctgcttccttgaagtgtgaattgtcccaccagggataaatgaaatagcacgccagataagacaatgtagctagcacagtgctgctaacgtaagtggcatctctagagggcaatatcacttacttgtggctgtcctttgtgtcccgccacacataatagtgtcactatcaattgggttgatgaacagttaataaagaattatttttactgtgtattaagtgcccaatatataaggattaattatttttataaaccaaacacccaaagataaccagattaaacgggtatactaagaagattatgtaactaaacctgtaatgatggacatttgtgctgttccattttttttaaattataaactaagccaatggaatcactattgtagttataatacaaacaaagaataagtgttcaataaataattgctatgggaatctttttaacataaattttttgagacagggtctggctctttcaccgaggctggagtgcaatggcacagtcacagctcactgcagcctctacctcccgagagcaatcaatcaattctcccacctcagcctcccaagtagctgggactaccggtgtgcgccaccacactgggctaaattttgtaatttttgcggaaacagggttttgccatgttgcccaggctggtctcaaactcctgggctcaagcaatccacccaccttggcttctcaaagtgaaaatttgaaatataagactactttagcactgtattaattatctctgtgggtacatcaaaaagctagaaagatatcaagttaacaacctaacatcacaactaaaagagctagagaaccaagagcaaacaaaccctaaagctagcagaagacaagaaatagtcaaaatgatagctgaactgaaggagatagagctatgaaaaacccttcaaaaaatcaatgaatccaggagctggtttttggaaaaaataaaatagatagactgctagccagactaatgaataaaagaaaaaaatcaaataaacacaatcagaaatgatagggggatatcaccactgaccccacagaaatataaaaaccatcagataatactacaaacacctttatgcacataaactggaaaacctaaaagaaatggataaattcctggacacatacagcctcccaagattgaaccaggaagaaattgaatccctgaataggccaataacaagttctgaaattgaggtagtaataaatagcctactaacagcaacaacaacaaaaaagcccaggaccagacatattcacagctgaattttaccagaggtacaaagaacagctgggatagtttctattgaaactattccgaaaaaattgaaaaggaaagactcctccttaattcatattaagaggtcagcatcatcctaataccaaaacctagcagagatacaacaaaaaagagaaaacttcaggcaaatatctttgaagaacattgatgcaaaaatcctctataaaatactggcaaaccaaatccagcaacacatcaaaaagcttatccatcacgatcaagttggcttcatccccgagatgcaaggttggttaaacatatgcaaatcaataaatgtgattaatcatataaacagcactaaagacaaaaaccacatgattatcgcaatagatgtagaaaagccctttgataaaattcagtatccctttatgttaaaaactctcaataaactacatattgaaagaacatacctcaaaataataacatccgtatatgacaaacccacagtcaatatcagactgaatgggcaaaagctggaggcattccccttgaaaaccagcacaagacaaggatgctctctctctcaccactcctattcaacatagtattggaagttctggccaggacaatcaggcaaaagaaagaaataaagggtattctaataggaagagaggtagtcaaattatctttgtttgcagatgaaattctcctatatctagaaaacgccattgtctaagcccaaaagcttcttaagctgataagcaacttcaacaaagtctcaggatataaaatcaatgtgcaaatattgctagcattcctatataccaacaataggcaagctgagagctgaataataaatgaacttccattcacaattgctacaaaaagaataaaattcctaggaatatagctaacaagggaagtgaaggacctcttcaaggagaactacaaaccactaataaaggaaatcagagaggatttcagtgaggacccaaacaaatggaaaacattccattctcatggatagaaagaatcaatatcatgaaaatggccatactgcccaaagaaatttatagattcaatgctatttccattaaactaccattgacattcttcacagaattgaaaaaaactattttaaaactcatatggaaccaaaaaagagcccaaatagccaagacaatcctaagcaaatagaacaaagttggaggcatcacactacctgacttctaactatactacaaggctacagtaaacaaaacagcatggtactggtacaacaacagacatatagactaacagaacataatagagaactcataaataagaccacacacctagaactatctgatcttcaataaatctgacaaaaactagcaatggggaaaggattccctatttaataaatagtgctgggagaaatggctagcaatatgcagagaattgaaactggaccccttccttataccatatataaatattaactcaagatggattaaagacttaaatgtaaaacccaaaactacaaaaaccctattagaaaatcctaggcaataccattcaggacataggcacaggcaattgcaacaaaagcaacaattgacaaatgagatctaattaaactaacgagcttctacacagcaaacaaaactcatcagagtgaacagacaacctacagaacgggataaaatttttgcaatttatccatctgacaaaggtctaatatccagtctccaagaagcttaaacaaatttacaagaaaaaaacagcccattaaaaagtaggcaaagacatgaacacacacttctcaaaagaagacatacatgaggccaaaaaacatgtgaaaaaaacctcaacatcactgatagagaaatgcaaatcataaccacaatgatataccatcttaagctagtcagaatggctattattaaaaagtcaaaaaacaacagatgctggtgaggctgcagagaaaaagaaacacttttacactgttggtgggagtataaatcagcaaccattgtggaagactgtggcgattcctcaaagacctggaaccagaaatatcatttgactgagcaatctcattactgggtatatacccaaaggaatataaatcattctgttataaggatacatgcacccgtatgttcattgcagcactaatcacaatagcaaagatatggaatcaactgaaatgcccatcaatgatagactagataaagaaaatgtggtacatatacaccatggaatactatgcagccataaaaaggaatgagatcatgtcttttgcaggcacatggatggagctagaagccattattctcagcaaactaatgcaggaacagaaaaccaaacaccatgtgttctcactgggagctgaatgatgagaacacatggacacatgtcagggaacaacacacacaggggcctgctgggggcagggagggagagcataaggaagaatagctggtggctgccaggcttaatacctgggtgatgagatgatctatacagcaaaccaccatggcacatgtttatctacataacaaaccttcacatcctgcacatgtgcccctgagcttaaaataaaagttgaagaaagaaaattatcattgtgggtaactattagaagtgaaattactggcacaaaagatcaaatattaatttttttttttgagacgaagtctcactctgtcgcccagactggagtgcaatggcgtgatctcggctcactgcaacctctgcctctcgggttcaagcaattctcctgcctcagcctaccgagtagctgggattacaggcgcccaccaccacgcccagctagttttggtatttttagtagagatggggtttcaccatcctggtcaggctggtcttgaactcctgacctcaggtgatccacccgcctcagcttcccaaagcgctgggattacaggtgtgagccaccgtgcctggccgatatttttatttttaaataatttacaaagttgatcttcagaaaaatttcaccaacatattcaataagagcaggggagagtgcatgtgtccccagtccttcaacaaatctgttaaaaattttcatgtaatctaatctatcagcatttgtctctttgttgtacagtcacactgcgtatcgattggtcaacgacaacggacagcatagaatacgataggctatagtatgtagcctaggagtgtagtaggctataccatatagatttgtataactacactctacgatgttcgcaccaccacgaaattgcctgatgcatttctcagaacatatccccgttattaagtggcacgtgactataaaggccttccacaccaaaagcttatgtggagataaacggagtctacccataagagaacaaacaagtgctacttattcacagcttttttatagcaaggaagtcaagccaccatcatttgagtctggcagagattcaaagacaggcaggggagtgggaaagctttatagtggaaaacaaaaacacaaagacttcagctacgctctgattggatgttgttgacgtgaggaagctagaggcaggccaactagaggcaagcatcctatgtgattgaatatgggttcatatttgggtttttcttgtttgtcatcaggtcaaaaaaattaaaaaggccagaaaggctagcaaattgattaaagtcctgaacatttctgcagatgctatactttggctttttgagctgcttgcagcaaaggttgtgggtcacagttctattttcgtatgtggtctggtcattgtatattcagtttctcacttaagataaattaatcgttgttttattttgcttcaaatataactttattttttattcatttgaaaatttatgtttgtacatgtcaggaaaaagggacaatttcatttattttggaaaatttttcttaagttttttctaaagggcaatattctattctttatacagtacttaagttcacattcatacgattttatcgggtgggtctacgttatttcagtggaatttaagagcaacattatcaagactcctcttctggaccgcccaactcattaaaaaaaaaactgtgattttcattaagattctttctttgattaatttcttaacaagaaaaaaaggacaaaagggcccagggaggtaagagggtacctgctggagaggtggtgggtggctggaagcggctggctaggaggcggggcgtggggcggtggaactcctgggctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaa

SEQ ID NO: 4827 - DNA, 2208 bp, human
cgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattgg

SEQ ID NO: 4828 - DNA, 10050 bp, human
gtgcctttaaattactgctttcggagggtgcatctagggggaggtgggaggcaggaaaacatcttcctaccggtctccctcctccctcccctccaagactcttcagggtttggagagtgattgctgcccagagagaatcttttccagctcccagctggcaggctaaggccctccggagcccaaggcgagcccaagcagaagccagtagggttatctgtgtcaggatcatttccaggggaatagttctggcccctggcaggtaaagacaggccagaggagaagaggcagaagaggagagaaagcaggctcttttgcgagcagcccaggttggagaaaggctctgtacttttggcgttcctgcagggatatcccctctcacattggcagccaggctgagaaagggcttcaagatccccgcagaatgacaactcttgttcctgcaaccctctccttccttcttctctggaccctgccagggcaggtcctcctcaggtgagctgagtgggggtgagaaggaggtgcatgcaaacactagccaagggggatgggcaacctgggcatctggcacactttcctctaagtttgcacaaagcccgcagtctggagggcttcaggggaggacacgacctcccccagttaggaccccaagagctttttattagagatgtcaaggcaccggtcatgctgggaatgtttctgcacaggtggaagcttcctaggcctgggtaggggctaggcaactaagccccagaatggagggtgtctgcccagccacctaaccctgtttccctatcatctgggccacacactgctcagatcgctaaaaatgatggcaacatctgtcaactgccagcccaagaggcttcaggtagcaggggtttgccccaagaccacatcaggatggagctgggctagacattctttggccttctgcagtcaccctgcctgtgctcacttggttgctccctattccttgagggggaaaaagtagcagtcacttcctgggcttgcaggaaagacaggctttgggctccctgtaaatgttcccccaccaattgcccctttctcattagaccaggagccagcctaggttggcagggtgagctgaacaggaaagatggctgtagcctgggctgacctgatcgtaagaggagtgcctcccaaggtggagggggtcagtaccactgcggcatactcctcctcctcctcctgttaatccaagaaacatcgcagggctgcttgcgtctgcaaagcctcctgccccactgtttgcagacacattggctggcaggcaggcagggatgcagagcagggcaataaacttctaaagagtgaaaagcagctcaaagtagaatggcagcacagctggagttgacaggaggatgcaggcagaagggggcaccacactgggccttgcaggccctccaggaggggaggctgcctcaaagctcaagctccagtagcagcattcccactggggcttggaaagcagaggcagttagagcaaaacgggcccttagagagtctggagtccaagtccttcgttgtacatacggaaactgaggcctagagatggggaatgacctgcccagggtggctcagctacctagcaccagagttagacttctctccctgcgccaccccaagactttacatgagaaagactgtcagctctggatcctcctaggtcctgaaggtgtttaggactttccaggaatgaaagagaggaaggagtggctgcacacggtgactctgctctcaggtcctcagacaagttagccccagaagagggtactgcaacaggggctggggaccaagactgctaagcccatagcctgtcccaggatactaggtctaggcttagcaggagaggtgacctgagagtggggctgaggacggcggggagggtccagtttctccacgtgcaggaccatgtggcctcccagcaggcaggtggcaggtggccagaagcagcagcagcacctggctagcgtggacatcctgtggtgaagtcacagacttctgcttgctccagcaccaccaccagcctccttggattttcagagcctgcctctgtccccagggtaagggcttcctcttccttagaagattcaaggaggcaggactctagacggtcaaggtggggctgccactgaccttcccctactttggctccttggcagcccaccctgggctgcctgcaccatagtattgtgatagatagagctagttttgaagtcagtagctcttgatttgaatcccggctttaccactcactggctgcatgatcgtgaagaattcacctcaccttgctgatcctcagtcttctcatttatataatgggggtaatcataatacttagttgagaggactaatgtgagaactaaactagacagagtgtgtaaagcatttagcatggggccttagctatttttattattctatcggtcactggatagtacatggatctactgggaaagaggagcccactggctagaagaagactagtccccagcaggacagcagttaccctgctgcccagtcccacagtgcggcagcggcagtgacagtggtggagtcggctatagagcaatgacagcaggcaggagggagcaggaggtgcctggcccagcctggagtccagctgagctcagccctgagcactgctcctgtccccaaggctttgctaagctcctagtccctagtttatctgttagctggcaagttggtaagtaggcatatgaaaggggctttgctgctattagagggaaacccgttaggggaaaagggggctggcttctaagctatgccaaagcacactggctccttcctcaaaatcaagctgttagcggggaaaatacgggagttgacctcagcatgtctaccctaccaggaggctttttcccatccctagagtcctgcttccccaccatagttgccaaaactagttcacctgcctgcagtggcatggtccttaactaaaacgtagctcaaacatagcttcctgttggagcacacaccagaagccaaaactccctcttcagaagctgggtcctacttcctgagcagcccagcataaagcccaagcaactgaagccaactctcagaaatacaagttgtccttgagcccttcccatccttgactaggctagacgggcaaaactttgtagtagccacatcatttcccgcaagacatcactcattgagtgttttccaagtaccttcagaaagagaacactggacgaggcctcagcctagggtttgagtcctgaccctgtcactagctctgagactttgaacaagtcagtcctccttttgaagcctcagttttctcatctgtaaaatgggaataacagtcctcactcccatctcactgagaattgggagggtaagaagacctactgtctgtgaaaacactttactagtactaactggcaggctgccgtgttgacttatggcgtttttgttctcattttgcaaatggcacccagagacccattgtcttctatcctcctgcctgaggggtatggaaactgagagtctgtgataagtgcagcacataactggcctcagacttttttacctctcctgtccagggtggccttggcaaaagaggaagtcaaatctggaaccaaggggtcccagcccatgtccccctctgatttcctagacaaacttatggggcgaacatctggatatgatgccaggattcggcccaattttaaaggtaagaaatcttcatcctataaaaactcctccctccccaccacctttggcagcacactagccagccagcccctattgccttccctaaggaaaggaggctggaggtccagggctggggctggttctaacagctcagaaggagcctcctcaccccattgtccatgggcctgtgtatctggcactgatttctcccagcagtgccctggcctgcagctcagggaaggagttctggaagctgctcccagcctcctggaatgccctgccaatggcctgtgctttgctaccctcaggcccacccgtgaacgtgacctgcaacatcttcatcaacagtttcagctccatcaccaagaccacaatggtaagggatctccctgctccccacttccagcctagtgtgagtgggaggagcccaccagataacaagctggcatcttttgccatatcagcccaaggaaggttccttctccagtgaaaaatgcctactgcccctgagatgtgttcccaacattcctcctcatggccctcctgcccctacaggcttgctgggcccctgggaatggcaatgtttctgaagggcccatatctgcaccctcccaggactaccgggtgaatgtcttcttgcggcaacagtggaatgacccacgcctgtcctaccgagaatatcctgatgactctctggacctcgatccctccatgctggactctatctggaagccagacctcttctttgctaatgagaaaggggccaacttccatgaggtgaccacggacaacaagttactgcgcatcttcaagaatgggaatgtgctgtacagcatcaggtgcaccgggtggatagccaggagagtttgcgttaaggggaagaatttggatgaagactgaggggtgggaggagggttcccttgcactgtgatgggccccagtaagccgatgtcacttctttcttactgtccccactaggctgaccctcattttgtcctgcctgatggacctcaagaacttccccatggacatccagacctgcacgatgcagcttgagagctgtaagtgtctatatagagtcacagagagcctggaataacagccagttaacccgacctcatgacatcacagacaggaaaagggccactcagagttgggaggaacttactcaagcacacccagccaattcttggcacagatgagactagaaaccaggggtccctaacccctagcccagtgtgtttttcatccccacgttatttgctgatctggctgttccatggggctggggaacgggaaggcatcagccttacgcacaaatgtgtttgtgctgttttggggggcgatttgagcgacatcttctctgcccaaacgtatgtcccctctcacagtgcctgaagtagttccacctttacctctcttgaattaagacattgaagatgcctataaaaatgccagagtgggcagggtgggggcactcgtggagccctgattccccacaaacatagataacctttgtagagaggtaggagatgacagttctaggcacaagacagtgcctagaatgaagaggtcagccaagggctcctctgtggcaggggtgccagcctggaggggctgcccaaagtgcagaggaaccaaggatgacaaggttgggtcatcacttatttccactccctcctcatctcctgggtcaggagagactgttagatctggagccatccactagatgttcacagaagaaggcttataaggctgtttccagcataaaataactgtgatgaatagaatgtgtcctatgtggtcagctctttagagttcttaaaccactttcacatccaggctctcaatatcccttcatggcaacgctgaatagtggggagagcagctactataattcccattttacagaaggggaagcgacttacccaaagtcacagagctactctgggtcaaggcccaacactggatgtctgtgagccttggtgtttctgctcccatctctacctgacatgtgcaaatatggtcatatacgtggcatgagccctcatgaactgctatgtatgtgtgaataacttgacatgttcagacattagctttaaatttgccccaactcaaggccctggctaggatctatggtatgcacattgtcccatgcatgactggcaggatataaatagctgtctcctccctgaggtgatgtggcagaagtcctggctctgaggctagctcagcttaagacatgtgttcggtacacatgcttactcccctcggcttgagatatggcaggaggctcccagctgtgttccttgacatctttccaaccctcttgacctgctttctaggtctgtcagaataatttctctttgggcttttctcaagcttgagaacagggtaggagaggagtctgtaatcttcctgatttacctgcccactcaggatgggcccatgagacaactgaccaagtgtcctctccagaaaagttttcctttccataatgagcatgaagctcctaaaccccagaccttactcctcacctgttctctcctgcctgttctgatcctacccctacccccacccagcatccatactctgcagccctctgccatctctgtcactttcagttggctacaccatgaaagacctcgtgtttgagtggctggaagatgctcctgctgtccaagtggctgaggggctgactctgccccagtttatcttgcgggatgagaaggatctaggctgttgtaccaagcactacaacacaggtaaaaaccaggatctttattggctgtgagccacaggagaaccttcagatgtgaggcaaggggacaaggcagctggcctctatcgaaggttcaatctatgtcagatatggggccaggtgcttcatataacttatttatttgtgacagcaactataaataccatttttcagaaagggaaaactgaggttctaagaagttagttaaatcaagtgtccaagtcgcacagctagtaaatggcagatttagaatttaaatccaagccttctaactccaaagtctgtgttcttgttcctgtcgcatgctgcagagcaaatgacagtgggtggacagtttcccacttttcctggggtcaactttgtgtggaagcggggaatccacatctggtaatagggagtgactatgctgaacccagagggaacaagcctgagggcagtggccagcttacagtccacacctcccactgtcgctaccactgccagctctcaggaacttcccaggtgtgaaatgtcagctaagaagtggagaagggctgctttcccaggctgagcatctgcccccctgcagcttctgtaagagttgctggctccacattttccctgacaatttgtctgcgcggagctctgaccctgaaatagaggcagcagcctgaagaggggagatcccgggtcccttccatggtgggctgatatgttttgggtgctgccccatgaatatgtgtgtgcatgtatgtgggggtgtggggagtgggaagaggaaaaggccattgaatttagaaaatgcaagggggaatgaaaattgatataaactttttggagtaaaaaagttggcaatttgtatatagatcagtggttttcaaactttggtgtgcactatattcccctggggagtctattaaaatgttgcctcctgggctctacctctcagagattctgattatggttacctgtacttggagtgatgcctagaaatctgcattttaacaagcatcctgaggattgtggtgcaggtggtccagcaaacatgctttgagaaactttagtctagaagctaaaattgtgtttctacttatttatccaggaatcctactccttgaaatgtattatatggaaatattccaaaatactgcattggccttagaccccaagggggctcctgggtggctgtttatattagcaaaaacttggaactgttttaaatatccaccaatagggcagaggttaagaaaattacatgtgcgtctgcttggtggactagtatgcagacattaaaaggaatggttacaaggtgcttatatcaatgtgggaaagtaggagtgaaaaaaggtaagattcggaggtataaatacagaatgattatattatggtaaaagaaacaaaccaaaagcatgcatttaaaaaccttaggtggaaatagcactaaatgtctctaaagtaatgtgatacaacagataagagcaagaactttggaggcagatagagctgagtttggattctggctccatcatttactagttgagcgcccttgagaaatataatttaatctcttcatgcctccgtattcctatctgtaatatgagagataataattttacttgccccaaagagttgctataggattaaatgaggtaaagtcaggtcccttagtaagggtttgataaatgtaagcttatgaatattattattccttctctacttcttattttttctatactaaacaagttttaattttggaattaaaaacaaaactgctattgcaaaaaaaagaagaagaagaaggaaagaaaggaaagaaagtataggtacctaataaaggcatgtcacggcaagaatcccagggtgggatgaagtgaggtggattcagggaacagtaagaggtcacagcatcatacaatgtgtcaaagccataatcagtcattgacaacatcactgactttgaagaaacaagtaggcctgataagactagacctaggccagaataaaataacaatatatgcatcttctccttcttgcttggattatcctgagcctctgcttccaagagaagctctgcgttagtattttcttagccctagggccctggaaagcagagtaaagtgaagtctggcaaaggaggtggagcattggtcggtgtgcctgggccaatgcactttttgttggtagaatagaatgttgcagcctgatgctctatgggaacctgctccccgctgtctggagctggtctctgttgggcactgttttcagatgtttgctatccggctcttctcacttgcttaagacacaagcagtgtttatcccagtgaattgttgttgctagagagcttctggggcactagcaagcacaagcatggcccctgagatctaagtggagtctaagctaattgttttgttaataatgataacaatagtaacagctacctatgtgtcaaacacctcaaatacattatcttgtttaatttttccaatagcccagtgatgcagttggtatcactactctgttttacaggcaaggaaactgaagctcaaaacgcttgggtgttttgcccaaagtcacacagtggaaggttcaggattcaaacccaggcagtctgactctggagccctcctgctccttatcctcttgctgtgcagtcacgtgaaaggccttccgctggaaatgaaagtgctgggagccaaaggccaagtctttgatggtcgctctgagagcttccttagtacgtacatctggcattacctggggccattatgaaaggctcattcatgggcccagctgaggtgcccagaggctggtcagtagagggctgccctaatcctgtcctaatcccctcaggctcagctacaggctgggtacctggggcctgacacctcacctctctccttgcagggaaattcacctgcatcgaggtaaagtttcacctggaacggcagatgggctactatctgattcagatgtacatccccagcctactcatcgtcatcctgtcctgggtctccttctggatcaacatggatgctgcccctgcccgtgtgggcctgggcatcaccaccgtgctcaccatgaccacccagagctctggctcccgggcctctttgcctaaggtgaagagacatgcaagggaacttgcttgccatagagtaccccatttcccattcatcccaatgtgccctcctgctcaccatttaccttggatttaaggttgagaagacccactgggcaaaagctggtgtcctgcattctctctccctgtaatatactgctaataacattgttgacaatgtggaggctggggttagggatactatctggctagggaatgaggagagacagtgccttactttgactctcttcaggaaatactagcatgtccaaggtcaaaagatcctcagcaagtagaaagtcctactgcctcataatacaaatgaggagaatacagcccagagtggtaaaataaccttcttaagatcatgccttataagaaacaaccaaaacaatatcagagttttgaaccaatttctgtcatcttactgtatcagaaattagaaactatcacaaagcgctctagagatattatcctttcttt

SEQ ID NO: 4829 - DNA, 21400 bp, human
gtgcctttaaattactgctttcggagggtgcatctagggggaggtgggaggcaggaaaacatcttcctaccggtctccctcctccctcccctccaagactcttcagggtttggagagtgattgctgcccagagagaatcttttccagctcccagctggcaggctaaggccctccggagcccaaggcgagcccaagcagaagccagtagggttatctgtgtcaggatcatttccaggggaatagttctggcccctggcaggtaaagacaggccagaggagaagaggcagaagaggagagaaagcaggctcttttgcgagcagcccaggttggagaaaggctctgtacttttggcgttcctgcagggatatcccctctcacattggcagccaggctgagaaagggcttcaagatccccgcagaatgacaactcttgttcctgcaaccctctccttccttcttctctggaccctgccagggcaggtcctcctcaggtgagctgagtgggggtgagaaggaggtgcatgcaaacactagccaagggggatgggcaacctgggcatctggcacactttcctctaagtttgcacaaagcccgcagtctggagggcttcaggggaggacacgacctcccccagttaggaccccaagagctttttattagagatgtcaaggcaccggtcatgctgggaatgtttctgcacaggtggaagcttcctaggcctgggtaggggctaggcaactaagccccagaatggagggtgtctgcccagccacctaaccctgtttccctatcatctgggccacacactgctcagatcgctaaaaatgatggcaacatctgtcaactgccagcccaagaggcttcaggtagcaggggtttgccccaagaccacatcaggatggagctgggctagacattctttggccttctgcagtcaccctgcctgtgctcacttggttgctccctattccttgagggggaaaaagtagcagtcacttcctgggcttgcaggaaagacaggctttgggctccctgtaaatgttcccccaccaattgcccctttctcattagaccaggagccagcctaggttggcagggtgagctgaacaggaaagatggctgtagcctgggctgacctgatcgtaagaggagtgcctcccaaggtggagggggtcagtaccactgcggcatactcctcctcctcctcctgttaatccaagaaacatcgcagggctgcttgcgtctgcaaagcctcctgccccactgtttgcagacacattggctggcaggcaggcagggatgcagagcagggcaataaacttctaaagagtgaaaagcagctcaaagtagaatggcagcacagctggagttgacaggaggatgcaggcagaagggggcaccacactgggccttgcaggccctccaggaggggaggctgcctcaaagctcaagctccagtagcagcattcccactggggcttggaaagcagaggcagttagagcaaaacgggcccttagagagtctggagtccaagtccttcgttgtacatacggaaactgaggcctagagatggggaatgacctgcccagggtggctcagctacctagcaccagagttagacttctctccctgcgccaccccaagactttacatgagaaagactgtcagctctggatcctcctaggtcctgaaggtgtttaggactttccaggaatgaaagagaggaaggagtggctgcacacggtgactctgctctcaggtcctcagacaagttagccccagaagagggtactgcaacaggggctggggaccaagactgctaagcccatagcctgtcccaggatactaggtctaggcttagcaggagaggtgacctgagagtggggctgaggacggcggggagggtccagtttctccacgtgcaggaccatgtggcctcccagcaggcaggtggcaggtggccagaagcagcagcagcacctggctagcgtggacatcctgtggtgaagtcacagacttctgcttgctccagcaccaccaccagcctccttggattttcagagcctgcctctgtccccagggtaagggcttcctcttccttagaagattcaaggaggcaggactctagacggtcaaggtggggctgccactgaccttcccctactttggctccttggcagcccaccctgggctgcctgcaccatagtattgtgatagatagagctagttttgaagtcagtagctcttgatttgaatcccggctttaccactcactggctgcatgatcgtgaagaattcacctcaccttgctgatcctcagtcttctcatttatataatgggggtaatcataatacttagttgagaggactaatgtgagaactaaactagacagagtgtgtaaagcatttagcatggggccttagctatttttattattctatcggtcactggatagtacatggatctactgggaaagaggagcccactggctagaagaagactagtccccagcaggacagcagttaccctgctgcccagtcccacagtgcggcagcggcagtgacagtggtggagtcggctatagagcaatgacagcaggcaggagggagcaggaggtgcctggcccagcctggagtccagctgagctcagccctgagcactgctcctgtccccaaggctttgctaagctcctagtccctagtttatctgttagctggcaagttggtaagtaggcatatgaaaggggctttgctgctattagagggaaacccgttaggggaaaagggggctggcttctaagctatgccaaagcacactggctccttcctcaaaatcaagctgttagcggggaaaatacgggagttgacctcagcatgtctaccctaccaggaggctttttcccatccctagagtcctgcttccccaccatagttgccaaaactagttcacctgcctgcagtggcatggtccttaactaaaacgtagctcaaacatagcttcctgttggagcacacaccagaagccaaaactccctcttcagaagctgggtcctacttcctgagcagcccagcataaagcccaagcaactgaagccaactctcagaaatacaagttgtccttgagcccttcccatccttgactaggctagacgggcaaaactttgtagtagccacatcatttcccgcaagacatcactcattgagtgttttccaagtaccttcagaaagagaacactggacgaggcctcagcctagggtttgagtcctgaccctgtcactagctctgagactttgaacaagtcagtcctccttttgaagcctcagttttctcatctgtaaaatgggaataacagtcctcactcccatctcactgagaattgggagggtaagaagacctactgtctgtgaaaacactttactagtactaactggcaggctgccgtgttgacttatggcgtttttgttctcattttgcaaatggcacccagagacccattgtcttctatcctcctgcctgaggggtatggaaactgagagtctgtgataagtgcagcacataactggcctcagacttttttacctctcctgtccagggtggccttggcaaaagaggaagtcaaatctggaaccaaggggtcccagcccatgtccccctctgatttcctagacaaacttatggggcgaacatctggatatgatgccaggattcggcccaattttaaaggtaagaaatcttcatcctataaaaactcctccctccccaccacctttggcagcacactagccagccagcccctattgccttccctaaggaaaggaggctggaggtccagggctggggctggttctaacagctcagaaggagcctcctcaccccattgtccatgggcctgtgtatctggcactgatttctcccagcagtgccctggcctgcagctcagggaaggagttctggaagctgctcccagcctcctggaatgccctgccaatggcctgtgctttgctaccctcaggcccacccgtgaacgtgacctgcaacatcttcatcaacagtttcagctccatcaccaagaccacaatggtaagggatctccctgctccccacttccagcctagtgtgagtgggaggagcccaccagataacaagctggcatcttttgccatatcagcccaaggaaggttccttctccagtgaaaaatgcctactgcccctgagatgtgttcccaacattcctcctcatggccctcctgcccctacaggcttgctgggcccctgggaatggcaatgtttctgaagggcccatatctgcaccctcccaggactaccgggtgaatgtcttcttgcggcaacagtggaatgacccacgcctgtcctaccgagaatatcctgatgactctctggacctcgatccctccatgctggactctatctggaagccagacctcttctttgctaatgagaaaggggccaacttccatgaggtgaccacggacaacaagttactgcgcatcttcaagaatgggaatgtgctgtacagcatcaggtgcaccgggtggatagccaggagagtttgcgttaaggggaagaatttggatgaagactgaggggtgggaggagggttcccttgcactgtgatgggccccagtaagccgatgtcacttctttcttactgtccccactaggctgaccctcattttgtcctgcctgatggacctcaagaacttccccatggacatccagacctgcacgatgcagcttgagagctgtaagtgtctatatagagtcacagagagcctggaataacagccagttaacccgacctcatgacatcacagacaggaaaagggccactcagagttgggaggaacttactcaagcacacccagccaattcttggcacagatgagactagaaaccaggggtccctaacccctagcccagtgtgtttttcatccccacgttatttgctgatctggctgttccatggggctggggaacgggaaggcatcagccttacgcacaaatgtgtttgtgctgttttggggggcgatttgagcgacatcttctctgcccaaacgtatgtcccctctcacagtgcctgaagtagttccacctttacctctcttgaattaagacattgaagatgcctataaaaatgccagagtgggcagggtgggggcactcgtggagccctgattccccacaaacatagataacctttgtagagaggtaggagatgacagttctaggcacaagacagtgcctagaatgaagaggtcagccaagggctcctctgtggcaggggtgccagcctggaggggctgcccaaagtgcagaggaaccaaggatgacaaggttgggtcatcacttatttccactccctcctcatctcctgggtcaggagagactgttagatctggagccatccactagatgttcacagaagaaggcttataaggctgtttccagcataaaataactgtgatgaatagaatgtgtcctatgtggtcagctctttagagttcttaaaccactttcacatccaggctctcaatatcccttcatggcaacgctgaatagtggggagagcagctactataattcccattttacagaaggggaagcgacttacccaaagtcacagagctactctgggtcaaggcccaacactggatgtctgtgagccttggtgtttctgctcccatctctacctgacatgtgcaaatatggtcatatacgtggcatgagccctcatgaactgctatgtatgtgtgaataacttgacatgttcagacattagctttaaatttgccccaactcaaggccctggctaggatctatggtatgcacattgtcccatgcatgactggcaggatataaatagctgtctcctccctgaggtgatgtggcagaagtcctggctctgaggctagctcagcttaagacatgtgttcggtacacatgcttactcccctcggcttgagatatggcaggaggctcccagctgtgttccttgacatctttccaaccctcttgacctgctttctaggtctgtcagaataatttctctttgggcttttctcaagcttgagaacagggtaggagaggagtctgtaatcttcctgatttacctgcccactcaggatgggcccatgagacaactgaccaagtgtcctctccagaaaagttttcctttccataatgagcatgaagctcctaaaccccagaccttactcctcacctgttctctcctgcctgttctgatcctacccctacccccacccagcatccatactctgcagccctctgccatctctgtcactttcagttggctacaccatgaaagacctcgtgtttgagtggctggaagatgctcctgctgtccaagtggctgaggggctgactctgccccagtttatcttgcgggatgagaaggatctaggctgttgtaccaagcactacaacacaggtaaaaaccaggatctttattggctgtgagccacaggagaaccttcagatgtgaggcaaggggacaaggcagctggcctctatcgaaggttcaatctatgtcagatatggggccaggtgcttcatataacttatttatttgtgacagcaactataaataccatttttcagaaagggaaaactgaggttctaagaagttagttaaatcaagtgtccaagtcgcacagctagtaaatggcagatttagaatttaaatccaagccttctaactccaaagtctgtgttcttgttcctgtcgcatgctgcagagcaaatgacagtgggtggacagtttcccacttttcctggggtcaactttgtgtggaagcggggaatccacatctggtaatagggagtgactatgctgaacccagagggaacaagcctgagggcagtggccagcttacagtccacacctcccactgtcgctaccactgccagctctcaggaacttcccaggtgtgaaatgtcagctaagaagtggagaagggctgctttcccaggctgagcatctgcccccctgcagcttctgtaagagttgctggctccacattttccctgacaatttgtctgcgcggagctctgaccctgaaatagaggcagcagcctgaagaggggagatcccgggtcccttccatggtgggctgatatgttttgggtgctgccccatgaatatgtgtgtgcatgtatgtgggggtgtggggagtgggaagaggaaaaggccattgaatttagaaaatgcaagggggaatgaaaattgatataaactttttggagtaaaaaagttggcaatttgtatatagatcagtggttttcaaactttggtgtgcactatattcccctggggagtctattaaaatgttgcctcctgggctctacctctcagagattctgattatggttacctgtacttggagtgatgcctagaaatctgcattttaacaagcatcctgaggattgtggtgcaggtggtccagcaaacatgctttgagaaactttagtctagaagctaaaattgtgtttctacttatttatccaggaatcctactccttgaaatgtattatatggaaatattccaaaatactgcattggccttagaccccaagggggctcctgggtggctgtttatattagcaaaaacttggaactgttttaaatatccaccaatagggcagaggttaagaaaattacatgtgcgtctgcttggtggactagtatgcagacattaaaaggaatggttacaaggtgcttatatcaatgtgggaaagtaggagtgaaaaaaggtaagattcggaggtataaatacagaatgattatattatggtaaaagaaacaaaccaaaagcatgcatttaaaaaccttaggtggaaatagcactaaatgtctctaaagtaatgtgatacaacagataagagcaagaactttggaggcagatagagctgagtttggattctggctccatcatttactagttgagcgcccttgagaaatataatttaatctcttcatgcctccgtattcctatctgtaatatgagagataataattttacttgccccaaagagttgctataggattaaatgaggtaaagtcaggtcccttagtaagggtttgataaatgtaagcttatgaatattattattccttctctacttcttattttttctatactaaacaagttttaattttggaattaaaaacaaaactgctattgcaaaaaaaagaagaagaagaaggaaagaaaggaaagaaagtataggtacctaataaaggcatgtcacggcaagaatcccagggtgggatgaagtgaggtggattcagggaacagtaagaggtcacagcatcatacaatgtgtcaaagccataatcagtcattgacaacatcactgactttgaagaaacaagtaggcctgataagactagacctaggccagaataaaataacaatatatgcatcttctccttcttgcttggattatcctgagcctctgcttccaagagaagctctgcgttagtattttcttagccctagggccctggaaagcagagtaaagtgaagtctggcaaaggaggtggagcattggtcggtgtgcctgggccaatgcactttttgttggtagaatagaatgttgcagcctgatgctctatgggaacctgctccccgctgtctggagctggtctctgttgggcactgttttcagatgtttgctatccggctcttctcacttgcttaagacacaagcagtgtttatcccagtgaattgttgttgctagagagcttctggggcactagcaagcacaagcatggcccctgagatctaagtggagtctaagctaattgttttgttaataatgataacaatagtaacagctacctatgtgtcaaacacctcaaatacattatcttgtttaatttttccaatagcccagtgatgcagttggtatcactactctgttttacaggcaaggaaactgaagctcaaaacgcttgggtgttttgcccaaagtcacacagtggaaggttcaggattcaaacccaggcagtctgactctggagccctcctgctccttatcctcttgctgtgcagtcacgtgaaaggccttccgctggaaatgaaagtgctgggagccaaaggccaagtctttgatggtcgctctgagagcttccttagtacgtacatctggcattacctggggccattatgaaaggctcattcatgggcccagctgaggtgcccagaggctggtcagtagagggctgccctaatcctgtcctaatcccctcaggctcagctacaggctgggtacctggggcctgacacctcacctctctccttgcagggaaattcacctgcatcgaggtaaagtttcacctggaacggcagatgggctactatctgattcagatgtacatccccagcctactcatcgtcatcctgtcctgggtctccttctggatcaacatggatgctgcccctgcccgtgtgggcctgggcatcaccaccgtgctcaccatgaccacccagagctctggctcccgggcctctttgcctaaggtgaagagacatgcaagggaacttgcttgccatagagtaccccatttcccattcatcccaatgtgccctcctgctcaccatttaccttggatttaaggttgagaagacccactgggcaaaagctggtgtcctgcattctctctccctgtaatatactgctaataacattgttgacaatgtggaggctggggttagggatactatctggctagggaatgaggagagacagtgccttactttgactctcttcaggaaatactagcatgtccaaggtcaaaagatcctcagcaagtagaaagtcctactgcctcataatacaaatgaggagaatacagcccagagtggtaaaataaccttcttaagatcatgccttataagaaacaaccaaaacaatatcagagttttgaaccaatttctgtcatcttactgtatcagaaattagaaactatcacaaagcgctctagagatattatcctttcttttgggatgagaaaattgaggtagaaaatagcaattaaagtcagtgaactccagttgtctgggcccagtgatgttttgattacgcaggaagatttgtgctgatgggactgggcacagattctccctgcctcatgtcttcatgtagggaatttagaggtcacctcaaagtccttacagtcagcaaggctctgaacgaatcagggaacaaggccatttattcattcaataaatatttattgagcatgtactatgtaccagccactgaactttgtcatggaaaaataacaggaagcaaaagcaacacagttccttgtggatcttacaatgaacatattccctcttgcactgatttgttgggaaccaggccctgtgatctcccatctctcagtgcttgttcctaagaagactttttactgcgggcttacacggcaggtaatttcagacatccatggtgaatttatgaatttgctacatggcgggggttggggagctagtgattaggagtaggagattggggtcagacagatttgggtttgtctcccaggctcatcatctactaataatttaccttaggtaaattccttaacctctcaatcatcttgcctataacatgggaataagaatattaccagttcctgctgggagcagtggctcaggcctgtgatcccagcactttgggaggctaaggcaggcggatcacgaggccaagagttcgagaccagcctggccaacatggtgaaaccccatctctactaagaatacaaaaaaattagctgggtatggtggcgtgtgcctataatcccagctctcgggaggctgagacagaagaaccacttgaacctgggaggcagaggttgcagtgagctgagatcgcaccactgcactccagcctgggcaacagagcaagactctgtctcgagagagaaaaaaaaaaagaatattaccagttccatagggttattgcaaaatataatgtattaacacacaggacagtgtttggcacataataaccgctcaataaatgttaactattgttataattatcaggtgtcaacgttgaaaaaactgagtgatgaatctggggctaaagcagctggtgttgtccctaattatttttgagttgtcagaaaccctttgaggtgatccaaaaccctatagggataaatggtgacaaaactcagatcagaatcacatgtcccgggaaacgttgttagagatcattttctgtaaatgtgtttcctagatggacagggatattggcaaggctctgagaggcaggctggacttaggcaagggctacacggccagaccaggctgtgatggtcgtgttttgataatgatgttgtaaggagaccagaagcagaaaagtagttcagacctaagaaccctgccctagtttattgcctctgccatgcaaggtgattcatctctaaagcagggaggtactgcaatttatgccttattcttgccaagagaacttccttttctggttccctcctgtgagtgaacataatccatctgctcccaggaatcacttagtttccttatttggaaaaaaaaaaaagtctttgtttgagggttgtttgcagcatttggtaccttcttgtcagattttaatgagttcttcatggcctcattggccagtaagcaaaatatccaggcctgcaccctgaactaaatagcctcattaaccagcccctcagagcaagggactcagtaagccagggactgtctgctcactcttgagtttgtgcaacattaagtttggtgggtgcccatgaggtcaggccaggggcttccaaaagtcacaccagtctcacacccctaatacaactctagtgtccagaatgagagtggtaggggcttactttgtaagggaactagattggagtggccattcctcatgttcccaagaaacaactgttactttgcctttatggtgccaccaaaggcactgattaccatctctttgccaggactttgatcccctcaactgcagggagctcaaagcagaatggaaggactaaatggaaatttattccagaggctaggagattagacctaaagttgcagcagggaaggagccacttctatctagatcctatcatctaaatggcctacagctattggggcaggtagtggtaaggagggtagagagcaagcagaagccagcagatatacacatcacatgttgctaaaccatctatctgttcattcattcaaaaaaatatttactatagtccagaaactcagctaggcattggaagcagaacagtgatcgagatagaaacagtccatgccatcgaagagctcacagtctagtggagggaatggccaggtatgtgatggatgctaagaagttgtaggtaacctgagcacatacagcaggacaaccgacacagactgggatgattagggaaggcttcccaggggatgtggtatctaaaatgagagctgaaggatgagtaaaagttatccaggtaaatgagagaaaggttagaggagattggctctttgggaaactactgaaatagttcaccacagcagattacaaggggtgtgatgaaactgaacaggtaggcaaaggctagatatcatgataaggggagcaaagactgtatcgtaagggtaatggagaaccactgaaggatcataaaggggagtgatataatcagatttacattttgaaaacaactctggctactgtttggagaacagattggaggtggcaagagtagatgcaaggagaccattcagaaaacttgcaacccttcagatgtgctaggatagcgagtggacagattcctgagtttttgtttttgtttttttgtttgtttgtttggttttgttttttagacagagtcttgctctgtcacccaggctggagtgcagtgacacgatctcagctcattgcaacctctgcctcccgggttcaagcaattctcccacctcagcctccctagtagctgggattacaagcatgcgccaccacacccagctaattttttgtgtttttagtagagacagggtttggctatgttggccaggctgatcttgaacccctgggctcaagtgatctgcctcttggactcccaaagtgctgggattacaggcatgagccacagcgcccggccgagatttctaagatgtattattgacacacttatcattaacaggactttcttcctagtgcttaaagtgtctttttctttgatggtctaaggaccttcatggccatctctttataataatgagtaattacctcattattgatcttaatagcaggtatttgatatccttgggagcactgtgggactgagggatggtgaatgaaataggatgccctcttagtaagtggcaaagtagagacaccaaaggatgcttcatcagggttgtctagtaacccactgccaccatctcagtgacattgccctaaaagagttagagcagggtttttcacccttagcactcttgccattcggggccagataattctttgttgtgtgtgtgcatgtgtgtgtgtgcatgtctgtatgtgtgtctgtgtgtgtctgtatgtgtctgtatgtgtgcttgtgtgtgtgcgtgtctgtgtgttgaaggccaggcagggagctgtgaactgtaggatgtttagcagcatccctggcctgtacccattagatgtctgtagccacctcctccctcaaaattgtgccaccaaaaatgtctccaaatattacccaatgtacctggtgggggacggagttgtccccagttaagaatcattgaagcagaggatttatttatccagtgaaacttgctccttacctggggtctgcagcaccctcacttcccatcatagcagtggctgatgaaagaagtggcctgtccgaaattctgttcttgctggggtgcgctatgtggtaagctcagcagctcaaaactaagtagcaggtaatttggttgagaagatgaaaaggtctaaacctgagctctgtcccccactcctggccccatccagctgcaatgcctggaagaggccagaaagtgggagacaaaagtacttagaggctgccaaggaaagcagtgagaggagagtacaaaggactggataggtggatgccaaccacatcttgcaactagcgaagcatccttaaaggggtgggtggtgttccctcagtatccctgccctgttctctccagggtgagagatgaggccccagcttactactgagctaaattcatcagcagagcctttccaaaagagcaacaaggaaaaccacaggaccaagggaagaacaggggtggaggagggaaaggaaggaactcctagtttgtcagtgagaccacagcctaagtaaatggcaatgccactgaattgaaagcccagaaccctcaggtcctagtgccaccttctcactgggtaatcttggctaagaccatctgctctgggccttaagtgtcctcatgtgtctcacatcggaattgtgaacgctgcctgaccaattaccactgaggctgtgaggaccctaggagataacagagggaagacaaatgcagtgttcatgctcattgctgtttattgaaacaaaagaatcagaagaagatcagaatgaagacaataataaaaagcagaagcagaagtacaagaagaataaagaaagaaagggaaagaattgtaggaaggaaaaacttgtagaagtagagggtggagagtgcgaagaggtggagtatgatgggcagtccgatcttttccatctgggctttcagacaatgggatatgtcatggaaggcttctttaaacaccagaagaaattcaggataaagctcaaaaagagcaggcaatcgataggggttgaaaatccactcagtaggccacggaaggacttcaagaaggttgatcgttctgtcgctggatgttgtaggtgtcctacgtgaaggcaatcgacatctggatggctgtgtgtctgctctttgtgttcgctgccttgctggagtatgctgccataaattttgtttctcgtcagcataaagaattcatacgacttcgaagaaggcagaggcgccaacgcttggtgagtacaactagggagcggcccactgcctttctcctttggactccttcctccctactccgcctccccacaaaccaagacccaccccagggctgcaaggactagataggcaatcagaaaccctggattcataagggcgcagtggctcacgcctgtaatcccagcactttgggaggccgaggtgggcggatcacctgtggtcgggagttcgagacctgcctgatcaacatggagaagccctgtctctactaaaaatacaaaattagccgggcgtggtagcgcatgcctgtaatcccagctacttgtgaggctgaggcaggagaatcgcttgaacccaggaggcggagtttgcggtgagccgagattgagccattgcactccagcctggtcaacaagagcaaaactccttctcaaaaaaaaaaaagaaagaaagaaagaaagaaacctggattctagtactaagctggtcactgttaagctaagtactttaatctctttgattactttaatctctttgattactttaatctctttgattttaatctctttgattactttaatctctttgattctgtaagtcagtatagtagattgattaagggcatgggcacactgcttgacatagaataagcactgaagatatgttagctagtagtagaaccttaccaagttagctaataagagattgctttgccaggcacgggggctcacgcctgtaatcccagcactttgggaggccaaggcgggtggatcacaaggttaggagttcgagaccagcctgaccaacatggtgaaaccctgtctctactaaaaatacaaaaattagccggtgtggtggtgggcacctgtaatcccagctactcaggaggctgaggcaggagaatcacttgaagctggcagtgagctgagatcacaccactgcactccagcctgggcaacagagtgagactccatctcaaaaaataagtaaataaataaataaataaaaagagattgctttgagtagtaattgctcccccacaaccgggaggaaggtagcccaggttgtcatacactaattggtggttaagaattcaacaatcaggcattggtgtctttctaggggagcattataagaggacccccataactaagttggaattgagaaaccaccacttgcctgttctgactgttggatttcttcttcttgatcttcattgggtgcattagagttgttgggcttgagttgttgttctccctcactcttttctgttaacctcatttcttctacagtaaagtgatcacctggggaaatataaaagaaatcttgtcgtcatgacaacagaggcagtttacccccaattgcccagacaataggtgctaggtaagttgtcatgacaacagaggtgcctgggccagcctcacagaagcaagtgtccaattatgagcaaagctgaaaggcttaactgagctacatactggttgcttaaccattagagacacagagttctggtctgtcttcagctctgactccatgttttctgtctaatctggaggctctaaagccagagaggcaagagcataatgacctctgggggatgggaaacaatgctgtgaacccactcttaaaatcctgactctagcttgtctgggccacactagcacaaggaatgttctctcctcaacacaccacctcccacctcagctgctccaggggcacccctaccgtatgtccgcactaaaaatatctcacaaactacctccttggtttcatgtcccttgctaaggttcctttctgctgagggcagggctcctgtctcatctagtggtttgaatttatcagtccctaccctttagtcctttagttggtccctgggcagtacgccctctagtggactaatccacaactacatgtcctcgagtaggactcattcttcaagaaacctaaaagcatttcctaacccataccaagggttagaaaaatatgtgtatacacctagcagaagggcaagaaaaaaggacactccattttcttttttctttttttttttttttttgagacggagtctcgctctgtcgcccaggctgtagtgcagtggcgtgatctgggctcactgcaagctccgcctcccgggttcacgccattctcctgcgtcagcctcctgagtagctgggactacaggcgcccgccaccacgcccggctaattttctgtatttttagtagagacagggtttcaccgtgttagccaggatggtctcgatatcctgacctcgtgatccgcccgcctcggcctcgcaaagtgctgagattacaggcgtgagcccccgcgcccggccaggacactccattttctaagctaactgtccccaccccctctttagctgtgtcgaacaaatctgcctgcaggtaccaagatcttatctttataggagttttgatcttggtgccttctcaatgcctaccttggaaaaaaaaaagcagactgccaaccaatccagagtcctttcaccagctaagttgcctgtatggatgtcccagcaacaaaaaggctgccattgttactgtagagctattccaggttgactctagtcccacctcctttcctgaactcctgcaacccgcaactgcctgcagcctgtcccctcctgctcatatatataggctgatcctgagctcataatggagtctgtcatgaccagtgctcaattattacaaagttacaacagcagcctgggccttgcttaggactctggggcctgcctaaaagtgggctgaggctttttttaacgtgaattattattattattaacgtgaataaaactgaaaatcaaacccgtgccattcgtcatgtccttttttgagtcttctaaagtcactgttatcccaggacctgtagcaggtattttggaggcaccaagcaggctgaaaaaattgttggagagttcatccatttctagaacctctgtccgggccctactgctccagctagggaaaaagaattcttcagtctgagagggcagggagaaaatccatgtgatctccagggaacccttagccaagagtcagttaggagtgttctaggaaccagccagccattcacatcttttcttctcaactctctcctcaaccaacaactccatagcatggtggccccctttcatgtcactgcctaaagtggtttactttttacccatgcaatcctacactgtcttcccggctagtccataagcttccccaggaaagggaagctctttttcatctcctcagcaggccttagcaccaggctctggacacagcagtcatgtaacccagctcaccaacttttacaggctgattggagaggactgtctttcaaactggacagagcaaaagctttgccatgatcaatagaataacttgataactggaagaaatttcaaaatactgcccagtcctctcaagggcttggtcccagaaccctgcccacctctcttcatcctccagcaccctcttcattccccattctctaatccctttttttctagcccctctcacttcaatacaaatcactctttcccatctccacactttacctcctacactgtgcattccctccttagcgtggttttgagatatcttccctctctagcttctcagtccttctcccctatagatagccaggggaaaaaaagttctattttaataggcatgtaagccacaaagtggtatttaaggctccaatgttcctttccagcacacacacacacacacacacaccccacacacaaacacccctcagaatttggcctaaatagagaatacccaaatgcaggatgccccacccctggatttcaagccattcatctttgctcctccagctacaacaggtgcagtatgttaaagtcacaaaaagccaagaccagcttactctgttggccatattttctctcctgtgtgaaatggctttttccagcctgggaaatgtgtccaaataactccctttagatttattatgattggagaaaagggaaaataattagatctatagaaacagaaatagcagttggatccaactttccccctcagagcttttttgccaacatcctttgcttacatcctctagccagggtagggctcaggggatcagggtgagtactgggcaacagggtcatctgagggaccctgaactggaaatcaaaggagaaaaccattttacttactcccctcattttaaaattattgcaaaatattttgtttgcctctggttcttcacctcgaaaatgggtccagcacaacctcctttgtcagaatagtgtaaaaatgaattacagagtacatgtgaggtgaaccaaggcctgtctttatgatgacaggtcagtttctagtcatgtcattatcaagggttactaggacctacaacaccaacatctcatacacaaagccacttttctttttttttttctttttctttttttttttttgagatggagtctcgctctgtcacccaggctagagtgcaatagcgcaatctctgctcactgcaacctccgcctcgtgggttcaagcgattctcctgcctcagcctactgagtagctgggattacaggtgcccgccaccacgcctgactaatttttgtatttttagtagagaagaggtttcaccatattggtcaggctggtctcgaactcctgacttcgtgatccgccagcttcggcctctcaaagtgttgggattacaggtgtgagccaccgtgcctggcaaagccacttttcagtgtgttgccatagctgcagaggtcccacgataaagaccctgtggtgtccctctaactgagagagacagagtgtttaaaatctactttatccacattttgtatatatctatgtcatacctatacaatatacacatatttttttcttataacttataataaatacctcaggtagccacaggatgaccagctcttcctgatttgccttgcacttccccagtttcagccctgaaagacccaagtcttaggaacaccttccgttctggacaaaccgagatgacagtttgcatcgtcctccaagaggccattgcacttcaggtgatttcttagatacctgaaactttgactctaaaaccatgaatactttaagaaattaccaccatctttgaaggaagcatttctcaaccctgtcctttagaagtaaataaaattaggcttgttagggttgcatataaaataagactaaataggctgtgaatgggggcctgagggcctcatataagtaaagctctctctattgacactcagaggttttggttctctctctctctctctctctctctctctcgctctctcttgctctctttctctctcaactttatctttctgtccctacttcctggctcctagctgcgtttagctactaaaggttgtcagctaactattggaaaatggacttttggcagtctgccgcattacttagtgcttatataaaatttacccctcactgggcatgtgtttatcctaatttggataactcattgggttatttaaaacttttggaattttcagttttaagttgagataaattttaaaagatacgattcaaaaggggaatgaattctgaagcttttgaaagtcattaaagtcaagtttactaagactgaatatctcaacttcactatctaatagttttgttgttttgtttattaccagtcagagataacttgacattgagatgtcctctcacagtggccggcacttcactggattttagataactctaaatgatgttttgcattttacatgggtagcttagagcctatctgccatggaatcatgacatacactatatatagcacgtagagctgcttagcatacatctatctcatgagtagtgttgtgaccataaaaagcatgcaatgggcctgtgtacccaaggcaccttgtctgcataacattccctatgagatattgatgggtggtctgttctctatccctctgcctttgagctttgacctcaaattctgccgtttcttccttgtaattccaggaggaagatatcatccaagaaagtcgtttctatttccgtggctatggcttgggccactgcctgcaggcaagagatggaggtccaatggaaggttctggcatttatagtccccaacctccagcccctcttctaagggaaggagaaaccacgcggaaactctacgtggactgagccaagagaattgacaccatctcccgggctgtcttccctttcactttcctcatcttcaatatcttctactgggttgtctataaagtgctatggtcagaagatatccaccaggctctgtg

SEQ ID NO: 4830 - DNA, 21355 bp, human
gctctgaaccccactccagctgctgccgactgtgcctttaaattactgctttcggagggtgcatctagggggaggtgggaggcaggaaaacatcttcctaccggtctccctcctccctcccctccaagactcttcagggtttggagagtgattgctgcccagagagaatcttttccagctcccagctggcaggctaaggccctccggagcccaaggcgagcccaagcagaagccagtagggttatctgtgtcaggatcatttccaggggaatagttctggcccctggcaggtaaagacaggccagaggagaagaggcagaagaggagagaaagcaggctcttttgcgagcagcccaggttggagaaaggctctgtacttttggcgttcctgcagggatatcccctctcacattggcagccaggctgagaaagggcttcaagatccccgcagaatgacaactcttgttcctgcaaccctctccttccttcttctctggaccctgccagggcaggtcctcctcaggtgagctgagtgggggtgagaaggaggtgcatgcaaacactagccaagggggatgggcaacctgggcatctggcacactttcctctaagtttgcacaaagcccgcagtctggagggcttcaggggaggacacgacctcccccagttaggaccccaagagctttttattagagatgtcaaggcaccggtcatgctgggaatgtttctgcacaggtggaagcttcctaggcctgggtaggggctaggcaactaagccccagaatggagggtgtctgcccagccacctaaccctgtttccctatcatctgggccacacactgctcagatcgctaaaaatgatggcaacatctgtcaactgccagcccaagaggcttcaggtagcaggggtttgccccaagaccacatcaggatggagctgggctagacattctttggccttctgcagtcaccctgcctgtgctcacttggttgctccctattccttgagggggaaaaagtagcagtcacttcctgggcttgcaggaaagacaggctttgggctccctgtaaatgttcccccaccaattgcccctttctcattagaccaggagccagcctaggttggcagggtgagctgaacaggaaagatggctgtagcctgggctgacctgatcgtaagaggagtgcctcccaaggtggagggggtcagtaccactgcggcatactcctcctcctcctcctgttaatccaagaaacatcgcagggctgcttgcgtctgcaaagcctcctgccccactgtttgcagacacattggctggcaggcaggcagggatgcagagcagggcaataaacttctaaagagtgaaaagcagctcaaagtagaatggcagcacagctggagttgacaggaggatgcaggcagaagggggcaccacactgggccttgcaggccctccaggaggggaggctgcctcaaagctcaagctccagtagcagcattcccactggggcttggaaagcagaggcagttagagcaaaacgggcccttagagagtctggagtccaagtccttcgttgtacatacggaaactgaggcctagagatggggaatgacctgcccagggtggctcagctacctagcaccagagttagacttctctccctgcgccaccccaagactttacatgagaaagactgtcagctctggatcctcctaggtcctgaaggtgtttaggactttccaggaatgaaagagaggaaggagtggctgcacacggtgactctgctctcaggtcctcagacaagttagccccagaagagggtactgcaacaggggctggggaccaagactgctaagcccatagcctgtcccaggatactaggtctaggcttagcaggagaggtgacctgagagtggggctgaggacggcggggagggtccagtttctccacgtgcaggaccatgtggcctcccagcaggcaggtggcaggtggccagaagcagcagcagcacctggctagcgtggacatcctgtggtgaagtcacagacttctgcttgctccagcaccaccaccagcctccttggattttcagagcctgcctctgtccccagggtaagggcttcctcttccttagaagattcaaggaggcaggactctagacggtcaaggtggggctgccactgaccttcccctactttggctccttggcagcccaccctgggctgcctgcaccatagtattgtgatagatagagctagttttgaagtcagtagctcttgatttgaatcccggctttaccactcactggctgcatgatcgtgaagaattcacctcaccttgctgatcctcagtcttctcatttatataatgggggtaatcataatacttagttgagaggactaatgtgagaactaaactagacagagtgtgtaaagcatttagcatggggccttagctatttttattattctatcggtcactggatagtacatggatctactgggaaagaggagcccactggctagaagaagactagtccccagcaggacagcagttaccctgctgcccagtcccacagtgcggcagcggcagtgacagtggtggagtcggctatagagcaatgacagcaggcaggagggagcaggaggtgcctggcccagcctggagtccagctgagctcagccctgagcactgctcctgtccccaaggctttgctaagctcctagtccctagtttatctgttagctggcaagttggtaagtaggcatatgaaaggggctttgctgctattagagggaaacccgttaggggaaaagggggctggcttctaagctatgccaaagcacactggctccttcctcaaaatcaagctgttagcggggaaaatacgggagttgacctcagcatgtctaccctaccaggaggctttttcccatccctagagtcctgcttccccaccatagttgccaaaactagttcacctgcctgcagtggcatggtccttaactaaaacgtagctcaaacatagcttcctgttggagcacacaccagaagccaaaactccctcttcagaagctgggtcctacttcctgagcagcccagcataaagcccaagcaactgaagccaactctcagaaatacaagttgtccttgagcccttcccatccttgactaggctagacgggcaaaactttgtagtagccacatcatttcccgcaagacatcactcattgagtgttttccaagtaccttcagaaagagaacactggacgaggcctcagcctagggtttgagtcctgaccctgtcactagctctgagactttgaacaagtcagtcctccttttgaagcctcagttttctcatctgtaaaatgggaataacagtcctcactcccatctcactgagaattgggagggtaagaagacctactgtctgtgaaaacactttactagtactaactggcaggctgccgtgttgacttatggcgtttttgttctcattttgcaaatggcacccagagacccattgtcttctatcctcctgcctgaggggtatggaaactgagagtctgtgataagtgcagcacataactggcctcagacttttttacctctcctgtccagggtggccttggcaaaagaggaagtcaaatctggaaccaaggggtcccagcccatgtccccctctgatttcctagacaaacttatggggcgaacatctggatatgatgccaggattcggcccaattttaaaggtaagaaatcttcatcctataaaaactcctccctccccaccacctttggcagcacactagccagccagcccctattgccttccctaaggaaaggaggctggaggtccagggctggggctggttctaacagctcagaaggagcctcctcaccccattgtccatgggcctgtgtatctggcactgatttctcccagcagtgccctggcctgcagctcagggaaggagttctggaagctgctcccagcctcctggaatgccctgccaatggcctgtgctttgctaccctcaggcccacccgtgaacgtgacctgcaacatcttcatcaacagtttcagctccatcaccaagaccacaatggtaagggatctccctgctccccacttccagcctagtgtgagtgggaggagcccaccagataacaagctggcatcttttgccatatcagcccaaggaaggttccttctccagtgaaaaatgcctactgcccctgagatgtgttcccaacattcctcctcatggccctcctgcccctacaggcttgctgggcccctgggaatggcaatgtttctgaagggcccatatctgcaccctcccaggactaccgggtgaatgtcttcttgcggcaacagtggaatgacccacgcctgtcctaccgagaatatcctgatgactctctggacctcgatccctccatgctggactctatctggaagccagacctcttctttgctaatgagaaaggggccaacttccatgaggtgaccacggacaacaagttactgcgcatcttcaagaatgggaatgtgctgtacagcatcaggtgcaccgggtggatagccaggagagtttgcgttaaggggaagaatttggatgaagactgaggggtgggaggagggttcccttgcactgtgatgggccccagtaagccgatgtcacttctttcttactgtccccactaggctgaccctcattttgtcctgcctgatggacctcaagaacttccccatggacatccagacctgcacgatgcagcttgagagctgtaagtgtctatatagagtcacagagagcctggaataacagccagttaacccgacctcatgacatcacagacaggaaaagggccactcagagttgggaggaacttactcaagcacacccagccaattcttggcacagatgagactagaaaccaggggtccctaacccctagcccagtgtgtttttcatccccacgttatttgctgatctggctgttccatggggctggggaacgggaaggcatcagccttacgcacaaatgtgtttgtgctgttttggggggcgatttgagcgacatcttctctgcccaaacgtatgtcccctctcacagtgcctgaagtagttccacctttacctctcttgaattaagacattgaagatgcctataaaaatgccagagtgggcagggtgggggcactcgtggagccctgattccccacaaacatagataacctttgtagagaggtaggagatgacagttctaggcacaagacagtgcctagaatgaagaggtcagccaagggctcctctgtggcaggggtgccagcctggaggggctgcccaaagtgcagaggaaccaaggatgacaaggttgggtcatcacttatttccactccctcctcatctcctgggtcaggagagactgttagatctggagccatccactagatgttcacagaagaaggcttataaggctgtttccagcataaaataactgtgatgaatagaatgtgtcctatgtggtcagctctttagagttcttaaaccactttcacatccaggctctcaatatcccttcatggcaacgctgaatagtggggagagcagctactataattcccattttacagaaggggaagcgacttacccaaagtcacagagctactctgggtcaaggcccaacactggatgtctgtgagccttggtgtttctgctcccatctctacctgacatgtgcaaatatggtcatatacgtggcatgagccctcatgaactgctatgtatgtgtgaataacttgacatgttcagacattagctttaaatttgccccaactcaaggccctggctaggatctatggtatgcacattgtcccatgcatgactggcaggatataaatagctgtctcctccctgaggtgatgtggcagaagtcctggctctgaggctagctcagcttaagacatgtgttcggtacacatgcttactcccctcggcttgagatatggcaggaggctcccagctgtgttccttgacatctttccaaccctcttgacctgctttctaggtctgtcagaataatttctctttgggcttttctcaagcttgagaacagggtaggagaggagtctgtaatcttcctgatttacctgcccactcaggatgggcccatgagacaactgaccaagtgtcctctccagaaaagttttcctttccataatgagcatgaagctcctaaaccccagaccttactcctcacctgttctctcctgcctgttctgatcctacccctacccccacccagcatccatactctgcagccctctgccatctctgtcactttcagttggctacaccatgaaagacctcgtgtttgagtggctggaagatgctcctgctgtccaagtggctgaggggctgactctgccccagtttatcttgcgggatgagaaggatctaggctgttgtaccaagcactacaacacaggtaaaaaccaggatctttattggctgtgagccacaggagaaccttcagatgtgaggcaaggggacaaggcagctggcctctatcgaaggttcaatctatgtcagatatggggccaggtgcttcatataacttatttatttgtgacagcaactataaataccatttttcagaaagggaaaactgaggttctaagaagttagttaaatcaagtgtccaagtcgcacagctagtaaatggcagatttagaatttaaatccaagccttctaactccaaagtctgtgttcttgttcctgtcgcatgctgcagagcaaatgacagtgggtggacagtttcccacttttcctggggtcaactttgtgtggaagcggggaatccacatctggtaatagggagtgactatgctgaacccagagggaacaagcctgagggcagtggccagcttacagtccacacctcccactgtcgctaccactgccagctctcaggaacttcccaggtgtgaaatgtcagctaagaagtggagaagggctgctttcccaggctgagcatctgcccccctgcagcttctgtaagagttgctggctccacattttccctgacaatttgtctgcgcggagctctgaccctgaaatagaggcagcagcctgaagaggggagatcccgggtcccttccatggtgggctgatatgttttgggtgctgccccatgaatatgtgtgtgcatgtatgtgggggtgtggggagtgggaagaggaaaaggccattgaatttagaaaatgcaagggggaatgaaaattgatataaactttttggagtaaaaaagttggcaatttgtatatagatcagtggttttcaaactttggtgtgcactatattcccctggggagtctattaaaatgttgcctcctgggctctacctctcagagattctgattatggttacctgtacttggagtgatgcctagaaatctgcattttaacaagcatcctgaggattgtggtgcaggtggtccagcaaacatgctttgagaaactttagtctagaagctaaaattgtgtttctacttatttatccaggaatcctactccttgaaatgtattatatggaaatattccaaaatactgcattggccttagaccccaagggggctcctgggtggctgtttatattagcaaaaacttggaactgttttaaatatccaccaatagggcagaggttaagaaaattacatgtgcgtctgcttggtggactagtatgcagacattaaaaggaatggttacaaggtgcttatatcaatgtgggaaagtaggagtgaaaaaaggtaagattcggaggtataaatacagaatgattatattatggtaaaagaaacaaaccaaaagcatgcatttaaaaaccttaggtggaaatagcactaaatgtctctaaagtaatgtgatacaacagataagagcaagaactttggaggcagatagagctgagtttggattctggctccatcatttactagttgagcgcccttgagaaatataatttaatctcttcatgcctccgtattcctatctgtaatatgagagataataattttacttgccccaaagagttgctataggattaaatgaggtaaagtcaggtcccttagtaagggtttgataaatgtaagcttatgaatattattattccttctctacttcttattttttctatactaaacaagttttaattttggaattaaaaacaaaactgctattgcaaaaaaaagaagaagaagaaggaaagaaaggaaagaaagtataggtacctaataaaggcatgtcacggcaagaatcccagggtgggatgaagtgaggtggattcagggaacagtaagaggtcacagcatcatacaatgtgtcaaagccataatcagtcattgacaacatcactgactttgaagaaacaagtaggcctgataagactagacctaggccagaataaaataacaatatatgcatcttctccttcttgcttggattatcctgagcctctgcttccaagagaagctctgcgttagtattttcttagccctagggccctggaaagcagagtaaagtgaagtctggcaaaggaggtggagcattggtcggtgtgcctgggccaatgcactttttgttggtagaatagaatgttgcagcctgatgctctatgggaacctgctccccgctgtctggagctggtctctgttgggcactgttttcagatgtttgctatccggctcttctcacttgcttaagacacaagcagtgtttatcccagtgaattgttgttgctagagagcttctggggcactagcaagcacaagcatggcccctgagatctaagtggagtctaagctaattgttttgttaataatgataacaatagtaacagctacctatgtgtcaaacacctcaaatacattatcttgtttaatttttccaatagcccagtgatgcagttggtatcactactctgttttacaggcaaggaaactgaagctcaaaacgcttgggtgttttgcccaaagtcacacagtggaaggttcaggattcaaacccaggcagtctgactctggagccctcctgctccttatcctcttgctgtgcagtcacgtgaaaggccttccgctggaaatgaaagtgctgggagccaaaggccaagtctttgatggtcgctctgagagcttccttagtacgtacatctggcattacctggggccattatgaaaggctcattcatgggcccagctgaggtgcccagaggctggtcagtagagggctgccctaatcctgtcctaatcccctcaggctcagctacaggctgggtacctggggcctgacacctcacctctctccttgcagggaaattcacctgcatcgaggtaaagtttcacctggaacggcagatgggctactatctgattcagatgtacatccccagcctactcatcgtcatcctgtcctgggtctccttctggatcaacatggatgctgcccctgcccgtgtgggcctgggcatcaccaccgtgctcaccatgaccacccagagctctggctcccgggcctctttgcctaaggtgaagagacatgcaagggaacttgcttgccatagagtaccccatttcccattcatcccaatgtgccctcctgctcaccatttaccttggatttaaggttgagaagacccactgggcaaaagctggtgtcctgcattctctctccctgtaatatactgctaataacattgttgacaatgtggaggctggggttagggatactatctggctagggaatgaggagagacagtgccttactttgactctcttcaggaaatactagcatgtccaaggtcaaaagatcctcagcaagtagaaagtcctactgcctcataatacaaatgaggagaatacagcccagagtggtaaaataaccttcttaagatcatgccttataagaaacaaccaaaacaatatcagagttttgaaccaatttctgtcatcttactgtatcagaaattagaaactatcacaaagcgctctagagatattatcctttcttttgggatgagaaaattgaggtagaaaatagcaattaaagtcagtgaactccagttgtctgggcccagtgatgttttgattacgcaggaagatttgtgctgatgggactgggcacagattctccctgcctcatgtcttcatgtagggaatttagaggtcacctcaaagtccttacagtcagcaaggctctgaacgaatcagggaacaaggccatttattcattcaataaatatttattgagcatgtactatgtaccagccactgaactttgtcatggaaaaataacaggaagcaaaagcaacacagttccttgtggatcttacaatgaacatattccctcttgcactgatttgttgggaaccaggccctgtgatctcccatctctcagtgcttgttcctaagaagactttttactgcgggcttacacggcaggtaatttcagacatccatggtgaatttatgaatttgctacatggcgggggttggggagctagtgattaggagtaggagattggggtcagacagatttgggtttgtctcccaggctcatcatctactaataatttaccttaggtaaattccttaacctctcaatcatcttgcctataacatgggaataagaatattaccagttcctgctgggagcagtggctcaggcctgtgatcccagcactttgggaggctaaggcaggcggatcacgaggccaagagttcgagaccagcctggccaacatggtgaaaccccatctctactaagaatacaaaaaaattagctgggtatggtggcgtgtgcctataatcccagctctcgggaggctgagacagaagaaccacttgaacctgggaggcagaggttgcagtgagctgagatcgcaccactgcactccagcctgggcaacagagcaagactctgtctcgagagagaaaaaaaaaaagaatattaccagttccatagggttattgcaaaatataatgtattaacacacaggacagtgtttggcacataataaccgctcaataaatgttaactattgttataattatcaggtgtcaacgttgaaaaaactgagtgatgaatctggggctaaagcagctggtgttgtccctaattatttttgagttgtcagaaaccctttgaggtgatccaaaaccctatagggataaatggtgacaaaactcagatcagaatcacatgtcccgggaaacgttgttagagatcattttctgtaaatgtgtttcctagatggacagggatattggcaaggctctgagaggcaggctggacttaggcaagggctacacggccagaccaggctgtgatggtcgtgttttgataatgatgttgtaaggagaccagaagcagaaaagtagttcagacctaagaaccctgccctagtttattgcctctgccatgcaaggtgattcatctctaaagcagggaggtactgcaatttatgccttattcttgccaagagaacttccttttctggttccctcctgtgagtgaacataatccatctgctcccaggaatcacttagtttccttatttggaaaaaaaaaaaagtctttgtttgagggttgtttgcagcatttggtaccttcttgtcagattttaatgagttcttcatggcctcattggccagtaagcaaaatatccaggcctgcaccctgaactaaatagcctcattaaccagcccctcagagcaagggactcagtaagccagggactgtctgctcactcttgagtttgtgcaacattaagtttggtgggtgcccatgaggtcaggccaggggcttccaaaagtcacaccagtctcacacccctaatacaactctagtgtccagaatgagagtggtaggggcttactttgtaagggaactagattggagtggccattcctcatgttcccaagaaacaactgttactttgcctttatggtgccaccaaaggcactgattaccatctctttgccaggactttgatcccctcaactgcagggagctcaaagcagaatggaaggactaaatggaaatttattccagaggctaggagattagacctaaagttgcagcagggaaggagccacttctatctagatcctatcatctaaatggcctacagctattggggcaggtagtggtaaggagggtagagagcaagcagaagccagcagatatacacatcacatgttgctaaaccatctatctgttcattcattcaaaaaaatatttactatagtccagaaactcagctaggcattggaagcagaacagtgatcgagatagaaacagtccatgccatcgaagagctcacagtctagtggagggaatggccaggtatgtgatggatgctaagaagttgtaggtaacctgagcacatacagcaggacaaccgacacagactgggatgattagggaaggcttcccaggggatgtggtatctaaaatgagagctgaaggatgagtaaaagttatccaggtaaatgagagaaaggttagaggagattggctctttgggaaactactgaaatagttcaccacagcagattacaaggggtgtgatgaaactgaacaggtaggcaaaggctagatatcatgataaggggagcaaagactgtatcgtaagggtaatggagaaccactgaaggatcataaaggggagtgatataatcagatttacattttgaaaacaactctggctactgtttggagaacagattggaggtggcaagagtagatgcaaggagaccattcagaaaacttgcaacccttcagatgtgctaggatagcgagtggacagattcctgagtttttgtttttgtttttttgtttgtttgtttggttttgttttttagacagagtcttgctctgtcacccaggctggagtgcagtgacacgatctcagctcattgcaacctctgcctcccgggttcaagcaattctcccacctcagcctccctagtagctgggattacaagcatgcgccaccacacccagctaattttttgtgtttttagtagagacagggtttggctatgttggccaggctgatcttgaacccctgggctcaagtgatctgcctcttggactcccaaagtgctgggattacaggcatgagccacagcgcccggccgagatttctaagatgtattattgacacacttatcattaacaggactttcttcctagtgcttaaagtgtctttttctttgatggtctaaggaccttcatggccatctctttataataatgagtaattacctcattattgatcttaatagcaggtatttgatatccttgggagcactgtgggactgagggatggtgaatgaaataggatgccctcttagtaagtggcaaagtagagacaccaaaggatgcttcatcagggttgtctagtaacccactgccaccatctcagtgacattgccctaaaagagttagagcagggtttttcacccttagcactcttgccattcggggccagataattctttgttgtgtgtgtgcatgtgtgtgtgtgcatgtctgtatgtgtgtctgtgtgtgtctgtatgtgtctgtatgtgtgcttgtgtgtgtgcgtgtctgtgtgttgaaggccaggcagggagctgtgaactgtaggatgtttagcagcatccctggcctgtacccattagatgtctgtagccacctcctccctcaaaattgtgccaccaaaaatgtctccaaatattacccaatgtacctggtgggggacggagttgtccccagttaagaatcattgaagcagaggatttatttatccagtgaaacttgctccttacctggggtctgcagcaccctcacttcccatcatagcagtggctgatgaaagaagtggcctgtccgaaattctgttcttgctggggtgcgctatgtggtaagctcagcagctcaaaactaagtagcaggtaatttggttgagaagatgaaaaggtctaaacctgagctctgtcccccactcctggccccatccagctgcaatgcctggaagaggccagaaagtgggagacaaaagtacttagaggctgccaaggaaagcagtgagaggagagtacaaaggactggataggtggatgccaaccacatcttgcaactagcgaagcatccttaaaggggtgggtggtgttccctcagtatccctgccctgttctctccagggtgagagatgaggccccagcttactactgagctaaattcatcagcagagcctttccaaaagagcaacaaggaaaaccacaggaccaagggaagaacaggggtggaggagggaaaggaaggaactcctagtttgtcagtgagaccacagcctaagtaaatggcaatgccactgaattgaaagcccagaaccctcaggtcctagtgccaccttctcactgggtaatcttggctaagaccatctgctctgggccttaagtgtcctcatgtgtctcacatcggaattgtgaacgctgcctgaccaattaccactgaggctgtgaggaccctaggagataacagagggaagacaaatgcagtgttcatgctcattgctgtttattgaaacaaaagaatcagaagaagatcagaatgaagacaataataaaaagcagaagcagaagtacaagaagaataaagaaagaaagggaaagaattgtaggaaggaaaaacttgtagaagtagagggtggagagtgcgaagaggtggagtatgatgggcagtccgatcttttccatctgggctttcagacaatgggatatgtcatggaaggcttctttaaacaccagaagaaattcaggataaagctcaaaaagagcaggcaatcgataggggttgaaaatccactcagtaggccacggaaggacttcaagaaggttgatcgttctgtcgctggatgttgtaggtgtcctacgtgaaggcaatcgacatctggatggctgtgtgtctgctctttgtgttcgctgccttgctggagtatgctgccataaattttgtttctcgtcagcataaagaattcatacgacttcgaagaaggcagaggcgccaacgcttggtgagtacaactagggagcggcccactgcctttctcctttggactccttcctccctactccgcctccccacaaaccaagacccaccccagggctgcaaggactagataggcaatcagaaaccctggattcataagggcgcagtggctcacgcctgtaatcccagcactttgggaggccgaggtgggcggatcacctgtggtcgggagttcgagacctgcctgatcaacatggagaagccctgtctctactaaaaatacaaaattagccgggcgtggtagcgcatgcctgtaatcccagctacttgtgaggctgaggcaggagaatcgcttgaacccaggaggcggagtttgcggtgagccgagattgagccattgcactccagcctggtcaacaagagcaaaactccttctcaaaaaaaaaaaagaaagaaagaaagaaagaaacctggattctagtactaagctggtcactgttaagctaagtactttaatctctttgattactttaatctctttgattactttaatctctttgattttaatctctttgattactttaatctctttgattctgtaagtcagtatagtagattgattaagggcatgggcacactgcttgacatagaataagcactgaagatatgttagctagtagtagaaccttaccaagttagctaataagagattgctttgccaggcacgggggctcacgcctgtaatcccagcactttgggaggccaaggcgggtggatcacaaggttaggagttcgagaccagcctgaccaacatggtgaaaccctgtctctactaaaaatacaaaaattagccggtgtggtggtgggcacctgtaatcccagctactcaggaggctgaggcaggagaatcacttgaagctggcagtgagctgagatcacaccactgcactccagcctgggcaacagagtgagactccatctcaaaaaataagtaaataaataaataaataaaaagagattgctttgagtagtaattgctcccccacaaccgggaggaaggtagcccaggttgtcatacactaattggtggttaagaattcaacaatcaggcattggtgtctttctaggggagcattataagaggacccccataactaagttggaattgagaaaccaccacttgcctgttctgactgttggatttcttcttcttgatcttcattgggtgcattagagttgttgggcttgagttgttgttctccctcactcttttctgttaacctcatttcttctacagtaaagtgatcacctggggaaatataaaagaaatcttgtcgtcatgacaacagaggcagtttacccccaattgcccagacaataggtgctaggtaagttgtcatgacaacagaggtgcctgggccagcctcacagaagcaagtgtccaattatgagcaaagctgaaaggcttaactgagctacatactggttgcttaaccattagagacacagagttctggtctgtcttcagctctgactccatgttttctgtctaatctggaggctctaaagccagagaggcaagagcataatgacctctgggggatgggaaacaatgctgtgaacccactcttaaaatcctgactctagcttgtctgggccacactagcacaaggaatgttctctcctcaacacaccacctcccacctcagctgctccaggggcacccctaccgtatgtccgcactaaaaatatctcacaaactacctccttggtttcatgtcccttgctaaggttcctttctgctgagggcagggctcctgtctcatctagtggtttgaatttatcagtccctaccctttagtcctttagttggtccctgggcagtacgccctctagtggactaatccacaactacatgtcctcgagtaggactcattcttcaagaaacctaaaagcatttcctaacccataccaagggttagaaaaatatgtgtatacacctagcagaagggcaagaaaaaaggacactccattttcttttttctttttttttttttttttgagacggagtctcgctctgtcgcccaggctgtagtgcagtggcgtgatctgggctcactgcaagctccgcctcccgggttcacgccattctcctgcgtcagcctcctgagtagctgggactacaggcgcccgccaccacgcccggctaattttctgtatttttagtagagacagggtttcaccgtgttagccaggatggtctcgatatcctgacctcgtgatccgcccgcctcggcctcgcaaagtgctgagattacaggcgtgagcccccgcgcccggccaggacactccattttctaagctaactgtccccaccccctctttagctgtgtcgaacaaatctgcctgcaggtaccaagatcttatctttataggagttttgatcttggtgccttctcaatgcctaccttggaaaaaaaaaagcagactgccaaccaatccagagtcctttcaccagctaagttgcctgtatggatgtcccagcaacaaaaaggctgccattgttactgtagagctattccaggttgactctagtcccacctcctttcctgaactcctgcaacccgcaactgcctgcagcctgtcccctcctgctcatatatataggctgatcctgagctcataatggagtctgtcatgaccagtgctcaattattacaaagttacaacagcagcctgggccttgcttaggactctggggcctgcctaaaagtgggctgaggctttttttaacgtgaattattattattattaacgtgaataaaactgaaaatcaaacccgtgccattcgtcatgtccttttttgagtcttctaaagtcactgttatcccaggacctgtagcaggtattttggaggcaccaagcaggctgaaaaaattgttggagagttcatccatttctagaacctctgtccgggccctactgctccagctagggaaaaagaattcttcagtctgagagggcagggagaaaatccatgtgatctccagggaacccttagccaagagtcagttaggagtgttctaggaaccagccagccattcacatcttttcttctcaactctctcctcaaccaacaactccatagcatggtggccccctttcatgtcactgcctaaagtggtttactttttacccatgcaatcctacactgtcttcccggctagtccataagcttccccaggaaagggaagctctttttcatctcctcagcaggccttagcaccaggctctggacacagcagtcatgtaacccagctcaccaacttttacaggctgattggagaggactgtctttcaaactggacagagcaaaagctttgccatgatcaatagaataacttgataactggaagaaatttcaaaatactgcccagtcctctcaagggcttggtcccagaaccctgcccacctctcttcatcctccagcaccctcttcattccccattctctaatccctttttttctagcccctctcacttcaatacaaatcactctttcccatctccacactttacctcctacactgtgcattccctccttagcgtggttttgagatatcttccctctctagcttctcagtccttctcccctatagatagccaggggaaaaaaagttctattttaataggcatgtaagccacaaagtggtatttaaggctccaatgttcctttccagcacacacacacacacacacacaccccacacacaaacacccctcagaatttggcctaaatagagaatacccaaatgcaggatgccccacccctggatttcaagccattcatctttgctcctccagctacaacaggtgcagtatgttaaagtcacaaaaagccaagaccagcttactctgttggccatattttctctcctgtgtgaaatggctttttccagcctgggaaatgtgtccaaataactccctttagatttattatgattggagaaaagggaaaataattagatctatagaaacagaaatagcagttggatccaactttccccctcagagcttttttgccaacatcctttgcttacatcctctagccagggtagggctcaggggatcagggtgagtactgggcaacagggtcatctgagggaccctgaactggaaatcaaaggagaaaaccattttacttactcccctcattttaaaattattgcaaaatattttgtttgcctctggttcttcacctcgaaaatgggtccagcacaacctcctttgtcagaatagtgtaaaaatgaattacagagtacatgtgaggtgaaccaaggcctgtctttatgatgacaggtcagtttctagtcatgtcattatcaagggttactaggacctacaacaccaacatctcatacacaaagccacttttctttttttttttctttttctttttttttttttgagatggagtctcgctctgtcacccaggctagagtgcaatagcgcaatctctgctcactgcaacctccgcctcgtgggttcaagcgattctcctgcctcagcctactgagtagctgggattacaggtgcccgccaccacgcctgactaatttttgtatttttagtagagaagaggtttcaccatattggtcaggctggtctcgaactcctgacttcgtgatccgccagcttcggcctctcaaagtgttgggattacaggtgtgagccaccgtgcctggcaaagccacttttcagtgtgttgccatagctgcagaggtcccacgataaagaccctgtggtgtccctctaactgagagagacagagtgtttaaaatctactttatccacattttgtatatatctatgtcatacctatacaatatacacatatttttttcttataacttataataaatacctcaggtagccacaggatgaccagctcttcctgatttgccttgcacttccccagtttcagccctgaaagacccaagtcttaggaacaccttccgttctggacaaaccgagatgacagtttgcatcgtcctccaagaggccattgcacttcaggtgatttcttagatacctgaaactttgactctaaaaccatgaatactttaagaaattaccaccatctttgaaggaagcatttctcaaccctgtcctttagaagtaaataaaattaggcttgttagggttgcatataaaataagactaaataggctgtgaatgggggcctgagggcctcatataagtaaagctctctctattgacactcagaggttttggttctctctctctctctctctctctctctctcgctctctcttgctctctttctctctcaactttatctttctgtccctacttcctggctcctagctgcgtttagctactaaaggttgtcagctaactattggaaaatggacttttggcagtctgccgcattacttagtgcttatataaaatttacccctcactgggcatgtgtttatcctaatttggataactcattgggttatttaaaacttttggaattttcagttttaagttgagataaattttaaaagatacgattcaaaaggggaatgaattctgaagcttttgaaagtcattaaagtcaagtttactaagactgaatatctcaacttcactatctaatagttttgttgttttgtttattaccagtcagagataacttgacattgagatgtcctctcacagtggccggcacttcactggattttagataactctaaatgatgttttgcattttacatgggtagcttagagcctatctgccatggaatcatgacatacactatatatagcacgtagagctgcttagcatacatctatctcatgagtagtgttgtgaccataaaaagcatgcaatgggcctgtgtacccaaggcaccttgtctgcataacattccctatgagatattgatgggtggtctgttctctatccctctgcctttgagctttgacctcaaattctgccgtttcttccttgtaattccaggaggaagatatcatccaagaaagtcgtttctatttccgtggctatggcttgggccactgcctgcaggcaagagatggaggtccaatggaaggttctggcatttatagtccccaacctccagcccctcttctaagggaaggagaaaccacgcggaaactctacgtggactgagccaagagaattgacaccatctcccgggctgtcttccctttca

SEQ ID NO: 4831 - DNA, 9906 bp, human
cgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttgggtaaggtgcctgtgcgtgggcaggaacaggggctaggggctggaggacccggaaggccgggaggtggggggcctgtgagaagagggagaaaggaaagtctagttgatccccaggaccactcgtagcttgagaaaagggactgagccgctcccgaggtcggagtcgggggcaggtgacagtgcaggggggcgttgctgagtaatcccgagctgctgccagagccgagcagagaggcgcagggctccgtggggagcgggtgtggctcagtgcgcatgcgccacagccgactagctctaagagctgggggtgaggtgagaggacctgggtcggaggtagttgggactatgtgtgacatctcactttctaggtccgtaatgctaacagtgcccctgtcgtagagatgccagcattcttgtctcccaaggaagctttttttccttgtgttcagctcgcttgatgtcatccaaaccttatctacctatctgtccctgggcagtctactgaggaagaagtgtcctggggacgatgccagattgctatctagtgtgcctttgggcttatagccctagagctgtcgttgtgagcagtgaaaggttagatgtgggactccacattggaccctttgagttgcatataggatataaatgtgggcatgaatgtaggaatagcgtttcagtggcatgacagctgtggcatttggagtcggcatggatgtagctgataacttgttagctctgcaaaatgaatccagtgcgtcagagggtttccgcgctacgaagcacccaccaccagcaccaacgccaagtattgggttgtattggaaacacactcaaacattcaatcatttctcatccgtgttgaattttacataaatatagccgcgcccaattcttcagtgcaatatttccaattattgtgccagcattcaacagtgagttgagtagcccttaccagtgtgtcgccacaagatgggctttccccacaggtccaaccatggctcctcccctgtacagacttccaacagtgccactctcatccagtgcctagccctccccagttgctcttcccctatcgatccctgcagtacacatccctttcaagacttgcctccgagcaatctgcactactgattttgagcatcattccactccatggcaactgaactgatgcgaatttgcttttctgcctctcttctctccatcatcatactaaaatgtactattttcaaaggttcaacttctttttcttcattgtactgcctcctcccccacctccactcccacctctaagcattcccaactaaatacaataatttgaataaggctttgtgggtactgcagattcagaaggtttcaagtgtgttaaagaacaaagagctggggagtattggttatggaaattcctaattcaccttactctccaagactgagaccctgatgggaaaaaaaaaagttagtaaactatccttagagcatgctcattaatgagtttgtgggggtaggaaaggggaattgcgtctctcgaatattttactcagttagagtcagatctttctctgaatgggatcaaaatcagaataagcgttttggtccaaatgctcgcccgacagaggacccataagggatgcatacgtcatttgactttcctatttacgtatttagtgttatcaaagaattcatttgcctgcttaatgttaccttgtttaaaggtttggattaaatccggcatattctgggggaggaaaaaatgatttcatttgcttttacactgtgctagttctttttaatttaagtatgtactaaaggacatgacattcattttcaaacaatgataaatgattgtggagaggccagcacccaccgacaacatcaactggatatcattattctgctcttgttttgggtaggaatggggaaatgtatatacttatttttaaaatgtgagagtagggggaggaaaactggagcatttcccttgactttcaacaggtggaattcccattactccccatccagaaaatgatcgagtcaagttcataacttctgctctttagttaccttataaataatagtattttggcatcttacagaactatggatctattgtaccttggcatcaattcagaggcattaattctgggcacctacctaatcatttaattggtaaacaaatatttattatctccatggaggatcctggtgctgcacactgaaggggcttcaaagatgtatacagtgagcttactatctaggaatttaaaattgatcatgtaagaaagacaggaaaagtttgttaacaaaataagtcagtataatgacattatttcaactgtaaacaatgagatcctgagcttgcatgttaatttgtaaactccctgagggcaagaccttgccttaaacatttattaattcccaacagtatctacatccaatggatgtttgagtgatgaagctttgcaaagtagattgagtggggagacaccagaagcagggagagaagaactttcacaatagattagatgtgagaaattgtgggccaaaatgaggatggtagcacaggactagaaaatgatacttcaagggaaaatcagcaggattgaatgaaggcaaggagacaaatctaaactgtattcatttttacttctagaaaataaatgggagttggagacagcagaggagagtggagggtttccttagtaaggacacaacacacaataggcactgtagtgttttctcaaatatcagtagcaagattggaccagaagaccctgaaggtcccttcaatgctgagattctgtgccatatgcagatgttcaagcttgttgaggaacaaggcattctcaaatatggaagaaagagaaaaggaagaattcttatactttcactagcaggccctttctgagaagggttaatactgagccacaaggcccccaccagtgcatgaaaggaggtggaggagccagaggaataaaaatctcaaaccaaatttttcaaaaaatgcttacaaatctttgcaaacttcataagcttttcattctcccccaaaatcctgttaagtagggcaggtattatctgctctatttttatgtaagaagatactgaaacagaaagattaaatgacctgcccaagttcataaaataaatgaatggtgtaacagtgatgaagaccctggtgtcctgattactgccagctagctcagtgctcttgacactgaaccacattgcttttcctctttttcccttggcatagagcctataggcccagaagttatgtgtgcacataaccaaatagggaatgcacaagcaactgcagcattatctcagacagttattaatacatcatcattattcctggagctgagcatttggtttccatattcactcagtccttgacctgtctattgagtttatctgcaactgggagaatagggtcagtgagtcttttaatgatgtgaacgcctgtttgctaggaactcaaggaagcttgtgtggcctggacgcttaatactagccatcagaatcatgcccaagtttgtacttctgttgcttttcaaaatgagagttcaagagttttgctctgtaaaattatcctacagaccagtataaaaaaataaaaaagtgtgctaacacttgtttcatctccatttaaagaaatgtttgttacttgagctaattccaaagacagcaatttgggagcaggaaaaagaggacaaaaattaggaattgtaggaaacttgagaattctgtagagtgtatataaaccaagaaggaggataaagcctatccatttaggagatattatttaaattcataattactgatttagatatctaatgaatccttattataagttttatctatatttagaaaataacatgtgattattaagcagcagatttttttttaaagcttcgttcttcctcagtaagaaataacactacacagatctaggcactgtttttcttcttaaaccagtactcttgatgctgcttaaataagattcttgccataattaattataatattagatgaatgtatatttaaatttaataacaccagctaaatattaaaactggtgtttaagacagatgaactgccaggtacagcggctcacgcctgtgaacccagcactttgggaacatgaggtgggcagatcgtttgaacccaggagtttgaaaccaacctgggcaacatggtgaaaccccatctctacaaaaactacaaaacttagccgggcatggtggtgcatgcccgtagtcccagctactcagaaggctgaggtgggaagattacttgagcccaggaggtcgaggctgcagtgagccatgactgcaccactgcactccagcctgggtgacagaatgagaccttgtctcaaatttaaaaaataaataaagaaaagaaaaatgacctaaactaattaataaaataattagccaagataatatactttattgtaaacaggaagcccacaaacacaatttttttctgctctctaattatgtggaatcaattgcagagacaaccttgagacagactggtgagtgcactaacaactttcttggagatgggaacgttggtaggtataaaaggaagaagtttcatctccgacttaggatttcagcatatcttagattgctctgtactttccttttcctgaatgtcatctattgtgaatatcatctttctttaatttgcttttactttgaatggagaattcaattgagagacaatataaaatgtaaaaaattatataaattacaaattaggataagttaaagttcttggaataaaattattttgcttatgttaagcataggtagcattttgaacttttatttttgaaaagcaccctctgtaggttacttgaggttgctgtgggttctttttttttttctgacttgaatatatttttatatagagccttaacgttattttattatagatttttttaaaataatgttttctattctgttttatagcaccctaaaaagaaagaataaaacaacaacaggaaaaaaaggaaaatatttaaattgtgacaaaaacccactgggtaggtatttcaagggggcacactgtggatttgggatattttaatatttgatctcttaaaaatgaatatttagaaaaatatatagctagtacataggcattccaaaatcattttaagggctactaaattttgtaaaattatattcaaatgtgtgtgcttccagaaactgttttgcatgcactccttcgattagtgattcgttttcatccctttgggtctattgtataaatatcatccaattaacctcatcaccgttgagttcccacaatagacctagtgggaaagtacctaacagaatataggaaaaggtagtatttgttcagtaagcatttgatctttttattttaagacacattctaggtgttccatgtgtagacatgttgtggaggtaacaagtagggtactgtataaatattagcactttaaattttgcagtatgttttcaaatgttgctattatggaattaaaacctgaatccaaaaactaataagctattcaagatttccttccttcatgacagctgttatattgatatcagtcaattgtcatcaacttaaatgccattgttccatgaagaaaaaaatatagaagatccttacttgagagggtgttcctatcaatgcaagtataatggggtaaatgcctgaagaaacgtaaccttgttctctctttcaaattctggggtgcagtctaattctggcccagacctctaccgacagaatcaagaatccagtttatgtagctttctcttctcagtaatttttgtatccatcaggagcagacttcaaaccccaagtcaatttcatactatttgtctattgtttggaactgtccaaaccggaagctaaagttgtcacacatttgagtggcattcctgttctaggcttcctctcctagaattgggtcagaactgaaccaaattacaggaccatctgctagtccatttacccatggcactcagccattttcctggcacaacaaaagacctcagaaaaacaagacctatttttccccttatgcaaaattagtgttatttcttctgctgtactacatcaattaatgagcataaatcagagaagttgaatgagaaggccttataattcagagaaatttgctatgaagttgatttcagtttcaggtttaactgttttccctcctacttttccttttattttcaggttctcttggttacaaactccttcccttctggtgctgcaaaaatgagtgggaaatccctgctcttaaaggtcattctcttgggtgatggtggagttgggaaaagttcgcttatgaaccgttacgtaaccaacaaatttgactcccaggcttttcacaccataggggtagagttcttaaatcgagatctggaggtagatggacgctttgtaaccctccagatctgggacactgcagggcaggaacgtttcaagagccttaggacacccttctacaggggagcagactgctgcctcttgaccttcagcgtggatgatcggcagagcttcgagaatcttggtaactggcagaaagaatttatttactatgcggatgtgaaggaccctgagcatttcccctttgtagttctgggtaacaaggtagacaaagaggataggcaagtgactactgaggaggcacaaacctggtgcatggagaatggggattacccttatttagaaactagtgccaaagatgatactaatgtgacagtggcctttgaagaagctgtcaggcaggtgctggctgtagaggaacagctggagcattgcatgttgggtcacaccattgacttgaacagtggctccaaagcagggtcttcgtgctgttaaagatagggagccttttaaaaatgtgccccaaattgatcagtcagtagtgtaagaataactgtgcccctctaagagtgcacacacacgcacacaagagggtaagagacaaggttctgattgtgaaacagagcctttcaaattgaagtgtagattgatttaaaaaaattaaaaattaaaaaaaatgaagctctatcaagccaagtgtattttgcgtgatttctgctatttccccttcttgtgtgtctcaggacatatcagaaaattttagtcctgagacagttaaatattttttaaatcacagtttaaacctagaacccagctgcatgaaggagttaaagagctacaactatttcttaaagtgttccattaatcaactaacaaatgtcactatcagactcttgccaagcagtttctgacatttctgccaaaggggaaaaaaatcagactttgagctgtattacaataaaaataataatgcaaataaggattcctaggcttgaattaaagaagttgtaatgattaggagtgcaaaagtataatgatatacactgacttgtttaaatccttatgtatggttcgctcccatctgagcttttcaaaaaatcccatctcaataagagatactctaatgacactggcaattgattatacttcttgtgtttgaagtcataggatactagtgaatggattatgcttaaatatgccaaccacctttgcaaataaatggttggtctgcttttaattcctaagtctacttttgctgcatagagatgttgcttctctgacaacctcttaccaatttagcaatgctgcttagtatatgaatttggatgcagtgctctctgctcatcatttagatggtcctttgatccaacatgctgggctcatggagaaggcttcataaaagattgggggataatgaacttttctcacaaggctccttaactcaaatatttattgcagaagaaggaactggtttcttatatgttgcactgtatgttcaactagcctaattaggacattgaaagtgacagaagagcagatcttaacccagtgttagaatgaatttcccataaacagagttgtccaacagtggaatggactgccttaatagtgagctccctgcctctgaaaatattcactggatgaccatctgttagaataccataaaaagattttctgtgctggctacatgttcaatataaagtcctttctggctctaagttctatgaatatataaactacatcagtgccatgctgtggttagatttatctgatgataacagctaagactatggagagggactttaaaaattctcaaaccattctgtgatcaatctttaacagcaactacatagctcttccttttgcttttgcactgtggcaggaaaaattcttgagctctgagtaatctttatgtgactgataaaaaacatcttaaagctcccatgttaaaatataaaaatggtttgacaatttttgattaccatgactgtcagttatatactatattatgaatatgcagtgtggttcttgttggttgatctgtttaccctgcatagattttaatctgtactttaaaacatctatgataaaaatagtgacagacagaaattaccccaaaaagagacctaggccaggaagggggtgggagctttcataggaatacagcctagaactctccattgtagccacgtatggaatcagccttacttacatgtaggacctttgtgctttaagagctctgggacatattggccaaatagaaaagaagaggacagtatttcaactcagtcatactcaatatttccaattaagatataatcctgacaccattgttcaattaactttgacgccagaagtcaaagccagaactgggaccccacagctcttaagtactggtccctatcctgcctatgcctatagccagccacactggtttccaagttctgtgatcattttgctacaatcatgttagggtgaaaatctgtacgtcagaactgttaaatgctaattatttttaagtgcatgagacctggggccttctctttctacttgcactctgcttatactagtttctatttgtagatctcaggccttcatcataaagacctctatcaactcacaaaagtatttgtctctattagagtggcatgtggtcatttgagtaaaaaaaaaaaaattacatgggtatcggattcataggcatcctgtccatctaagacaagtgttaattttattggcccatcagctggagcccctttcctcttagccataccattgttttctaccaaattaccactcaatatcttaatgaaagcactcaacattaagtgacataaacagtggcatttgggtaagcaacactcagtggggtgctgacatacagtttgggtaagattaaaaaacaccaaaggctgaaatctgtgagtaccaagaactgtgcatataggtttagaaattgactgtgtaccctagaatgtgcagtgtaatattttcaataggtgtttttttaaagaacactagatttttggaataatatatttctaattaggactatactgtttttcaatggtctgttaaaacatcatacagaatatttatttagtttattgtcatgtattggctaactttcaggggcctcagattccatatgtcttcagtggattgatgaatatcaggttaatttgtgcctgccccagccatctctactttattctgaggtattccacaatcctcttgttgcaggtgctgctaaaaaaaactcaaaattgtgtatcaaatattttctttcaactgtaaaaaatcatctgtgttaaagtgaataaaaagtgcattttgaataaccagcacaca

SEQ ID NO: 4832 - DNA, 2126 bp, human; identical to SEQ ID NO: 3532

SEQ ID NO: 4833 - DNA, 13715 bp, human; identical to SEQ ID NO: 3533

SEQ ID NO: 4834 - DNA, 47075 bp, human; identical to SEQ ID NO: 3534

SEQ ID NO: 4835 - DNA, 3644 bp, human; identical to SEQ ID NO: 3537

SEQ ID NO: 4836 - DNA, 3312 bp, human; identical to SEQ ID NO: 3538

SEQ ID NO: 4837 - DNA, 47075 bp, human; identical to SEQ ID NO: 3534

SEQ ID NO: 4838 - DNA, 741 bp, human; identical to SEQ ID NO: 3541

SEQ ID NO: 4839 - DNA, 3298 bp, human; identical to SEQ ID NO: 3542

SEQ ID NO: 4840 - DNA, 3424 bp, human; identical to SEQ ID NO: 3543

SEQ ID NO: 4841 - DNA, 57810 bp, human; identical to SEQ ID NO: 3544

SEQ ID NO: 4842 - DNA, 136066 bp, human
cagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttgaagaaataaaaccaaatgaagaggtgaagagacatcttaatcacttgtgttgaagtttgcattttgatgcaaagtagagttgataaagcaagtaaagaaaccttcatatgatggtatcccttgcagtaattatcctcaataggacatatgtggaggtcagaaaattgccatctgtaaacaccaagtataccaatttggcaacagccagacaatgagggaagattcaaacattggagttgcaaactgagaaaaaacattcagaatgtggaagaataaataaatatgactctagtttaagattgatacattatgtcctttgcaggcctagccagctaaatgaccacaagacaaagacccttgagggaggatagacttgctttacaaattgagaattgaagaaattggtaggttatttggtatttttgttattagatagatattatttttaaacctaaaagagtaaacaggaatgaaagctaggaaacaagaaacggtgacaaaattatataactttcaacattaaaacattcacttttatacaatgatataactttttcacgtaatgcactaaaatcagagacaaaataagagagccaatgtaattacaatagatcaattccattatgtttgttaattaatgggttactgtaattttctgattttctattgaataaatattttctataggtgaaaaaacaaaaaaggaagtgcagagatttgtggtttgtgtttcctttctgaaaagagaagtacaaagctttatgtctttatatatatctttgtaatatatgtgtgtatgtatattcaccttgcccaccagcaatacctagggatgtgcgtgtatgcctctctgtctccgtctctctctctctctctctatatatatatatatacacatacacacacacacatatatacatatatatgtttgggtgatatatatatatatggtaagatatatatatgattatatatatatggtaagatatatatatgatcatatatatgtgataatatattatcatatatataataatatgtgataatatattatcatatataatatatatgataatatatatttcatatataatatatatgaaatatatattatcatatatataatagataatatatatttcatatatataatagataatatatagtatatacattatatataatatattatatatattatcatatatataatatatatataatatatatatattcctagtatgcctgtgtccttgagactggaaactatttcttcctctccaaatctgtcatgtctttcactatgactatcccctttgccttctgtgcccagtatggtaatgacattcctcacggctgtggccttggtatttgacactgccatgtgcagtcctaatctatattggggtcaggattagacaggccttgaggggacagtagtggcagaggttatctgaaatagcacatgatccaaaaactatatttgaaatacattaggcttatatttaaatataactgccagctctacccagaccaggcctgctatccacatttggtcatgagaaatttcccactttaccaagttccttagccccctgttcagaagcagttttaccttcatttcagttaactataattgaaatattcagcataatcctcaattacatatatatagagcatcacctctgcataacactgcacatcagtttattttctcagtcttttttccagtttctagagcaatggttttcatatggtagtgcacaagaacagcgcacaaaaatcaagaataatttggagattttgggacccatgatcaaaaattctgatatcgtaattccaaggaatctgtatttttaacagtattacccagatgattctcacgtagcgagagtctatacagtctacagtttgagaaacactgggctggatgaagagatttcccctttaatgccaccatgtaaattgtgaagcccattcctctgactatctctgaaactcactcaggcactcatcttgccatatccatccctttcatgttctctctccataaactcttttcataaaattgctgtttctaatattacaaataaaaggaggaaagcctctgctgtctccttcaaggtactgtgcagtctccttctttttgcagcctgactgctggagcgtgtttcctcactctcctttactatcctaaatttgaaatttcttgctactcatgttgaccatttttggttcctttttctccttagtctctgccatatttggttctgtggatcagcttctgctttgaaattctctcccttgaccagttaacactgctttctattggctcttttccttccagttactcccatccctggcttttattaaaattagccatcaagatggtctttcttccctgcccttgaattcaggagacagaaacgactccccagaatttgagatttcagtgggcagccagactaggacttttaaactgcaggagataatttagatgcatagaaagagataacgaaagtacaacaggtttgtctaacagtttatggttcaaaaatgttttaagacttagatttttagtaatttattgtaagacaaactagaaattagtttcttctttactgaccattttgtatacccaaatgggacatcaagacataccaaacccccaaataatctccaaattggtatagcagtcatagatacgaacatctaccttctggttttcttatctcaaggtggcagggcagaggaaaggaccaaataattatggaaacccctctgacgtggaacttctattttcacagtgaccaaaaagattgttcctttccaattcttccttccttggaaacccagaataaacttgctctgactgtaagtgcaaaatatatgaggaatttggcgttgttaacctagtattaagcatagtccttctcctcttttccccaatttaacgtttagtcttgaaagagagtagcatggagatggggaacaaaaatagcatatagaactaaagaaaacaatatagtcttagaatatatgaatactaagttgagctgcctttaagaggaaatttttaaaatgttcttttattaaacatgagtatgaaagatggtttggtcattcgagagcagaaatcaagtttcccaacatagatatgaggcctccatgaattttgacgggcattttattctagtccatttccttggtgtcttttttgaataattaggtaactgtattcaaatcagggtaaagtatttatgttattgaggactagagaaaggaataaagaaatttaagactgtgctcaaagattcaaaaataaagcttgtacagatgttacaataattctctaatatatggtatcttttccagctaaaatgcagccttaactatagcaaagaatagtttaccaataggaatcagctaacatgtttgattattttgacagatggccaaagactgtttctccagaattaacaatgtctaaaataaatccctcaatgatatccatcacataaatatgctacagtgataaagtcttcaagtcagtccctagtaacttttttgttggcttttctctcataaatctttcaatgagttataacaaaagtgatatgcttaataataagggtaatataatgatctatttttacttcttagatcctaaaaattatcattttagataaattacatgttcgttgggagtatatttctggaactatttctttgaaatgataactgtgtattgtgatcttaactttgatgatcattttgaaaaactaagctgctaggctgctgctttatctaacaatgcttttatcaattcagtggaaacatctagattttagaatgactgatagactatgatttttatctgtagaattttagagctgggagatcacctatcacaagacttttattttatgtatgtgaaaactgaatcccagagagagtaaataacttacccagagtcatatagttaattaatggtagagctggggctaaaattcaagtcttctgactctctgtccagttgaatacttattgaatgatgtaatcccaaagctgtgtcattttcctatgacagttttgctagattacacaaatatcacggcagttttaaggagtttataatttcattcatctaagttgcatatgctcaatagttttcctgtttagcttatatttatcacagcaataaaaatgttttcaaacaggattaaacaacgtttgtgtatataaaataaactttcaataaggtatgtgaatttccaagaatttgccaatgttcttaccactttgtgtataaattggcatctactcatgccttatataagttttgctaaaatagcaaaataggctgctagactaaaagttcaaacagtgataaaattcaagaaaccatattttgtggtgaacaatcaaggagtacccatatttaaaggtaagaaaacaatacttgaagataaatatggaagcctcataactctatcccaaaacatgttatgttttgtttcctatgatgccacatttagggttaagccacagaaaacgtcactttgtgccatgaacaggtatttagcagatgcaaagtttaacttttaaaaaattgtctaattttcttaaaatgatgctcttttaatatcatgatcttgctttgttattcatatttagtgatggtatttcttttttaagagctgttacaggttggtgcaaaagtaattacggttttgccactattctaatgccaaaaccgcagttacttttgcatcaacctataattcaaataagtaatctaaactttgtatccaacatctagtcatcattgttgcatgttaaattttctgcttgtctagttatcactcaaaagaataacatcggctgggcgcagtggctcatgcctgtaatcccagcactttggaaagctgaggcgggtggatcacgaggtcaggagttcaagaccagcctgaccaacatgaagaaaccccgtctctgctaaaaatacaaaataagctcagctactcgggaggctgaggcaggacaatcacttgaattcgggaggcagaggttgcagtgagccaagatcacgccattgcactccagcctgggcaacaagagtgaaactccgtcgcaaaaaaaaaaaaaaaaaaaaaaaaaaaaaaagaagaagaatattaaaagagtacttccattgcaaataaatgaacttatttctattttatctttctaattacatcattaatatgcctcagccttacataattgtgtgcattttacagttttatgataaataattacacgactacttaatgtccatactgcttattcttttttatgaatgagtatagtcagttcaaggagattgtgacatgtctattattttggtaaatgacatttaggttcttcccatgtaaattttaacagaacaaggcagattggaaataccacttaagatagttgaatgcagccataaaaaaggtagagttcatgtcctttgtagggacatggatgaagctggacaccatcattctcagcaaactatcacaaggacaaaaagccaaatgccacatgttttcactcataggtgggaattgaacaatgagaacacttggacacaggaaggggaacatcacacactggggactgttgtgtagggggaggggggagggataacattaggagatatacctaatgtaaatgacgagttaatgggtgcagcacaccaacatggcacatgtatacatatgtaacaaatctgcacgttgtgcacatgtaccctagaacttaaagtatatatattaaaaaaaagatagttgaatgctcacctaatttcctaagaagattaacaatttttattttacttttttgcaggatccaactggaatattctcactagataaaaccattggccttggtacttatggcagaatctatttggtaagttgacttacattatttattcattcttcattttctaatgacaacaaagattgtgagtcagacactgcaaatcacataatgccaaaatatggcatttcactttgagagagaaatcaaattagatagcccagtgacacctgtaagaattactgtttattatcacaaaagtaatggattggctaatctatagtgtaccaaccaaccaaacataacatctaaaaattagcagaaaataaagtcaccaatggaaaattgaagtaattcaaataagatatacccaaataagatatcacttgtcttatagtatacatccataccattctaaatactcacattcaactgaaaactgaatgttattaaaaggaatgttttcataacattctatatcatactgtgtacttgagtgtgcacatgtgtgataaaattttctaaagaatctaacaagaaaaaatctgaatttatttagtgattacttatggtaaacactaagtatgtgcagatgctgtgatagtctctgggaataaaatgatgaacaaagcagataaagtcccttctcttttggggcttatggttgagaaatgtatgtgagtaagtatgtatatgttatatgtgttgggtttgttgggggagccatacattacataagtaagcacacaaataactgtatacttctgtatctgtgcgttccacatccatggattcaaccaacattgtatcaaaaattaaaaaaatgcgtaatgtacagacttttgttcttgtcattattccctaaccaataaagtgtaacaactatttatatagcatttacattgaattaaatgttataagtaatctagtcatcacttaaattatactggaggatatgcgtaagttatatgcaaaaaaaaattactgtgccattatatatcagggacttgagcatgccctgattttagtgttcacgggaggccctgaaaccagtcccccacagatactgaaggatgactgtaattgcaactgtaatataagatctgtaagaaaattcttagtgatgtaaaagcataaagcaagggggcttaatttagattgaaatgtcagtgttgatctcccactccctggaaagggaaagtgaccgttaaactgatatcagaaggataaatatgaggtaaccaagaaaaggtgtggttgtggaggatgatgttaatacattctaggtggaggcatggacagtgttaagggctggtttggggatggggtgctttagtagccatatcacactgatcaggtacctttctattctctaatatggggaactgacattttctcaatcttgtgtaatgttctatataattgcagtgttctttttccccaggcctgttgctcaaaaaccggattactgtccttaggctgatccttacagcagactgatcacaggtcctccacatataggttgtatagaggtgtcctagtataagcccagaggagaaggggcttctttctagttcagaaaagggtgccttttttcttgccaagtcttgcaactttgggactacatctacccagaggggcttcttttcttattcatctgcccaggtgggaaaggagtatgctttttaaactttgcacaacagctcctatagggcctggtgctgtggctcactcctgtaatcccaatactttgagagatgaaggcaggaggattgcttgaagccagagttgagatgatcctgggcaacaaaacaagaccccagctctacaaaaaattaaaaagaaaaagttagccaggtgcagtgggtgtgcacctgtagtcttagctactcaggagtctaaggcagaaggatcacttgagcccaggtgcttgagactgcagtggattatgtttacaccactgccctccagtttgggtgacagagcaagaccttatcgcttaaaaaataaaaataataaaataataaactaaataaagcacccatagcatagaaactgagtagtagaaatagcatgtggacaggtcttaaaaacagaaagaaccttggtgaatatagggaacagagggaatgctagtattcatgaccaaatgttttcaaaccattttgatcatatctattaacagaaccaataagctatagagggtgatataatatagactgaaatatattgcttaggctacctcaattccatcctgtactgaatgattatttaatatttgtgcgatctaggtcagttttgccaccttatacatagatacctacatcttatacatagatacctacatcttatacatagacaaaatatttatggtacatttacagtctccatggctgtatgcacattttagttccttagggtgtgtgtgtaagtgtgtgtatatacttgttctgattcaaatgtatagagccaccagatgtgagaaataaaagctcagagtcatataaggtaagaagcaaggttaaaattagacaacacagaaagatggctactcattatcattcatgtgataatgaactgtgatggcaccaaaagaagaaaagtaagacggtaaaaaggtaagttatgcatgtgaatatccttttttaaaatcagggtttattgggatataatatatatttggtaagattaactcttttaagtgtacaactttatgagtttggacaaatgcatacagtcatataactgccaccacaatcaagattttcaatgtacatcttaaactaatcacagtctagattcaaggagtattctacctcttcactgtgtggtttcccaactggtgtactctagggttatggctgtcaggcattttgcttttacatatgctacaaacccacaaaactactgtactttccctatacttactcttttccctgttttcactactactatttttaaaatttagctaatcaattatcttttacagcaattaaaagtcagaaagagtcttttatgtttatcttcattttaaccatttctggaatcttcatttctttagtgtagatccaactttccctctggtgtgtacaacttaagcctgaaaaacttcctctaatatttcttatagtccaaggcttctgagtaatgaattatctgcttttgtgtgaaaagtcttaatttctccttcatttttgaaagatattcacactgtgtataaaatgtggattgagagttattatttttttctttctctcagcagtttaaacatgccaatttgtcttcagacttgcatagtttctgaagtctgctgtaattcttacctttgctcctttatattttgtctctggcttcctttaagatttttctctttgtctttgtttttcagcagtttaaatatgaaatgtctggaggtgtgtgcgtgtgtgtgtgtgtgtgtgtgttgaaaggatatttatctgagataatggttagagatctttggggttctcttagcttcctggacatgtggtttgacatatttcattatttgggagaaatttttggcctttatcttttcaaatattttttctactctatttgctttcttcttcttttggaaatccaatttcatatgtgttaggccttttgatattatccctcagttcttaaatgttctgttttggagtgtgtctgtgtgtgtttcattcttttttttctctttgtgtttcagttttgatcaattttttttctatcttcactttcattgattcctttctcagctgtttcaagtctacttatgagagagtcaaggacattcttcaactatattactgtttttcatttctagcatttctacctgactctttaatagttaacatgtgtactgaaatcccctatttgtttattcatgtttttcatatttttcactaaagcatttcatgcattaatcatagttatgttaaattctctgtctgatggattcaacatctaagtcatctctgagaggctggttatgttgattgctttgtctcttgagaatgttttttattttactttatttcacaatttttgtttaaatgacatagtatgtagaacagtagaaattaaagtaaatagtatttatttcttgaaatgggcacactttttcagctaggttgtttatatgggaattcactcaatctaataagaagataaactacatttgagttatgttgttgatatggttactctcagttcactaccagcttcagattcctctaataccttgtgcatatgtgggggttggtcttctggagagtttttcttaatatccctgttcttttctcaactttccatattccttgtgtatctgtgcttcaaagaggttcttgctccatgctgttgccctcccctaatggtatactgctattgcttcttattaagttctcattggcctggtggtgtgggcaggtagaaatgctctgtttttctgcttcaacctcagtcttgtaagatcctgggcctctgtgtcacaggagtgagactttcttagttatcctttccctcttctagtggtaggatacttctaattgtttgggcccacaactaattcttgcccttctcccaaaattggaggactttttttttttttttacctttccccagctgcagtaggtcttcatctttaccctggggagaatacactttgctgcctttcccctagggcttaagacttttattcatgaaaaggaaaggaactggacctggtttcctacctttcccactgcagtggcttctcatctccatcagatctgtaccataaatctgtatgtttgtataaatttgtcctgtgtctatggcttccaagggttctatactctcatgctaacccacatttgctctttagcagttcactaaaaatttgcatgcttgcaaccaaaatatctcatgcacctcataaatatatacacctattatgtgcccacaaaaattaaaaaacaaagaaaaatttagttgaattctttatacctgcttccgttgtgaccttgtcttccctctacagccacaggtgagctaatgctcatgtcccatctctttttgcaggtgcttgtctttctccagacctcagcctagttggttgccttgagacttctctatagattgaagaaaagttacgattagctagattattcagcttattcttgttgttagggtggatgtggcacactttccaactttcacatcctcatcaaaagcaaaaagtccatgttaattccttttaactgactcttcatgaagaatataccatatgctagatcctcctgtacacatttataaatcctaagaattttctgtgtacctactcagatccagagatagagaacaatttctaacatcagatcttccaagtacaaacttccttgttacagaaggtagatgcttaaaaaaacttcatttacaccagaatgatttccgtctgtcactcattgactttacctctttttttctacctctaattactataaaaatatttgggatggtggtgctatccactgacaataccctcatggaaaacaatctgggagtatgtaaataaacacttaaaaatgtttatcctctttacaccaataattcaacttttggaaatatatgataaacatcccagacatagacaaacatgtagatatacattgcagaagaaaagtagcatattgtggtgaaaaaagggcgtgctttgaaccaggcagacctgattcagtgcttacttagccattaactagctataaccttgagcaagtcacttaacctaagtttaagtttccttatttataaaatggggctaataatacctaccttgggaggtgctataaaatatcaaaacaatatacatatatgtacacatttgtaatatttggaatatggtaaatacctgttaaacggcagttattgccatcattattgttgctattattttttaaaagttcaattacaatagtttaaaaagatggaagtaaattactttttaaccagctaatatatcattgtcctataaagcaatatttatgaagttatctagcagcatagaactatgtttaagatcttaagtaaagtattccttattatatttgtgccccagttacagctatgttaaaatatgcagataaaaaatggtgaattaacgattagaatagtgagatattggattttttcttttctaatgtctgtaatataatatttaagtacagaacatatatatctgtacgtatatttaacatattatatatatgtgtgtattagacagtaccaaatgttgcataaataacctgtactgcaaaatagaagcatgataccattcaaaattaatgtcagagtgactcatagagtcctttgctttttcagtgctgccaaccacatcccctgctggagtttgttttggttaaagtctctccaatgtcttccagcttgtttccaaggcttcgttccctggcaggtttccagctgtctgctgaagtctgtgcacattgaaatgaaggctgagtctcacactactattgtaatcctcttcctttccttctttttcctctaattagatgcctatcctctcaccctctcccacctcctgccagttcaagcctcacttgaaattgtgggttctatttttctctctttttaggagagaaagtactggtcttctcttttttgccccagtagagttagagaatatagttttctcctcacctttaactgctagtctcatagtttatgggtcgtcattttaattggaggaatgtttagtatttgaccatgtgaggccatattagaaaaaagaaaataggttggaactcatttttaatggtactttttaaaaaaagtaatttccccaagagcaatagacacagaaagaccacagtattaagaaagagaccaagacctttagggtggcaaaattggaggtggcaacctgactctcccagtaactgacagtaaacgtgtttcttgactttctgggcccatttcttcaacaataaaacaaatgtattagactctataatctccaggctttcttctggctctgagatattgcacctagcacagtgcctggcactcagtaaaatgtaacctattcttattcttactgtcatcagcataattatagtgatcctattgtcgcttctccaccttacacagtagaagttgattattggctattagctggagtagtttcactttttaccaaataaaattatttttaacatgtttttctattcttttcttctgttttaccacctgatagtgagacctgatttttagctcagtaactaataagacactcaatgtgaatgtaaaactgggtagctggtatattgggaaggtaggaatgcttcattatatatgttatctaacaccattttgttaaggttaatactagtgaggtgagacaatgaattggtatccagaatgaatgagtttgccttggcccttcatgaggtcttgactacacccctaatatcagtcacctactcctacgttaccatttgcaggtggtgaggacagaaaaaggaatgggaaaggattcaaggcaaccatttcaagcaaaggaaaaattcacctgaaatagagtaaacttctacagttgggcatacagcctaattgccatgtacgctgatgcctagttgaaactcagttaaatgctggtggaagaaagggaccaccccaagtttcttattgttttaacacctaaaaacagaccatggccatatgtgagcatccatccttgaaagagatcacaggagtcatctgtcttcttggtggtcagtagattaagtgaggtatatgaaggtcacagtcaggagcaaattcctgaattgtttgcactctgaaagtatacaattaaatatggaaatttcgtttcaaaacaatgcatcacccttaaatttggttttataaatcaccgcctgacacattgcttttatttgcaaacctcaccagacagttgagatttatgtttattagttatattttctggatttgaagttggtgcagggaatgggaatggaaaggaaggaaaggaatgttgtcctcaaagttgatgacatacaatttatgatattttaaattacatttcagaaacacagtgctgacatttgggttgcctagccactaggcctattggatgggggtttgagtatttttccttttaggctgaaattatactgtttatttgcctaccaaatgtctagcactgtgaatgctttctttttaggtagaaaagtttccctcacatccttgccattttgcaaatatagcttaattaagtcagccaacaaataatgcttgagcaccccttaaagcacatagcactatgcatttcattatacattgcaagtttctgaagcaggagctgaagctgaagctgagttgaggccacaggcatactaggctattgtgtcttcatagtacagtgccacaagtccagagctatgtcttggttccaccttcatcctgtgacattgtgataatgtgcctcaaaagtagggattgatatttcttaaggaaccctcaagctgctctagcatagaaaacattaaatttacctattaacattgatttgaatgtgtaaaccattctgtaataaaaatttaaaaaatacatttattgaatgcacagtatgtcccaagtatcatgttacatactagttgctagttagaatgatcagaatacattttttaggagcggtcatttttattaagttagttttagtagagataaggaaggaagtattttctgtatgaccgtgaccgctttatttgaagagggagtgatgggtaatggaaaggagtgagagagattggaaaaaatgaaaagaggaaattgggacatagtttttttgtttttgttcctgtatgtagaaagtctaatgaagcttctaaagaatgagactccaagaacaagtttttcctcaataagaaaacaggttgaatatttgcaatgggggtgaaaaaaacagcataggctaaataaattgagactcaggggaccaaattagtggaaattgctgaggcttacaggccttggagaaaaatggaatatttctatcttggccgtgacaactctccaactgtggaatagaatccaggcctctgagttgcaggctttactttttcttattatgttataccaaaattttcttttgcttcccaataaatcttgagggaggatgaagcagttggtagctgacaggtatgaaaggggaaagtaaatgtcatgggatttttgctcccaagaagtcataattatttttcacaactactctaatctgcttaatatgttcacagatatatattgggaagtaattcaaattatgtatttggtgtatttgggtaacacaaaatatattatgtcatttctgcagatgcttaatccagttgattgttataaagttgttccaggagcaggaaaaataaatttaaatatttggagacaaatacacatttctaaacaaaagccaaaactaataaattctttatagcatggtggctttggtcaaccagataaaaacatcccaattatgaaaatctttatgaaatgtaagtataaatctccatggcgaaataatgcagttccttaaaaataggcatacaaaattgcctgattgctgctaagcttatatatttaatgctatttttaatatattagtcctaggaaaatttatctgtacaatattttataaaccactttatagagtgatgagggtgggttgggcagtgttagaagtaataatgtactttttaatatatcaaaaagcaaattttgttttattttgcttttgcgtatatatatgtatgtatgtgtctgtgtgtgtgtgtatatatatatatatacatagagagagagttatataattatggtcagattttcagagtaaattctgttaaggtggttgaagtatcacaagttcttgctttagtttatcgtctagtagttgaccactaaaaactagttaactaggtcctcatcacatttcatgaaacactctttggaaaatagcacttcaacagttgttactcttgaaataagaatagtcctaacttgattttaggacttccaacattctaccatacttgtgcatctgtgtctaaggtagttgtgtgggtggtgccaaaatcgcacttggagattaatgtgctgctgtagctctctgagggtgtcaaaagaaaagtggaagctcttataattttatgatgctgaggctactctgaaggcaggcttctaaaaagcagcttatcagtaagactaaattaaaatatcaaagaatataaaaagacataaacagatttttatcctgcagttttattttttcctgcttacctacacccaggttgtaataaattcctcctctaccagagcataaagagagggaaaatgaagtgggaattttgtgttatttcaattgtagaaattatgatatgacggtagtttatgtgtaatttgtgttagaaaactaagaaagctccttttgggtttgtccttcttagccagagtccctttatgactagggaaagaaggttagattgttcagggtcccctgagggaaagaagattgattatattctaagcactgccagtaacattttgtataaatcattaactctgaagagaaaacaaaacaaaaataccaccatgatctaaaaggagaagtctaagagtcctcagagaaagacagcttttcttgactctgagaaataaaataaaataaataaaattattgagtgtttgaactgggtgagaaaaagatggagatttaaatattagtcactttagagatagtgacctcaatgttctaaaaatggataacatttactgagtgcttacagctcataagagcattatgaggtagctaccattgttttcatcatcctaccatctcacaaacgagcaaacaggattcaagaacctgagttactgaataggttcacaaagctaagatattgccttgcaaagtcaggatttaaaccaaaatttgcttggcccgaggtctgtatcttaatcataatatagtatattcagctcaacagatataaaccaaagtcaaaaaacattcaattagattagccaattgaaaaaacaatctgcccaagtgcaaaaatttacaagaaactaatgagctgaggtcggtaatgaagatctttaatgatgtgtctctccaacatatttgtttccttcatgatgggcactaagacagtctagtcttagggtctttttctggaacgtaatagatttcagaaatggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccacctaagtaactttctattctgactataaaaaggtggcactgtgtagagataaatatttccaaaggatggaaatattagccttacttttttattactttctgctgaatgagtcatttaggaagcttgaaagagtatattttttctctgggtactgtagtttgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcagggactagataatattcattgtttcttttatattccctgcagtagcactgtgctgaatcaaactttgttggttaattctatattttgtagttttccttattcaaatcttatattccagggccctgatgaccagatagaggggtgaaggaatagagcctggtaagtggggaaagagagaaataggatgcaagagaccttagaactagggttgccagatttggcaaataaaaatacaggatgccaagttaaatctgattttgatgaagaacaaatacatttttaatgtaagtatgtcccaacagcatatagttatactaaaaaaagtttacttgaaattcaaatgtaaatgggcgtgttctttactttatttgccaaccttacacagaatcaactttacccccatcacagatttgccacctgacaacgtcatgttaagaaacaagaaagaaactgactctcccacctgctgtggtgtggcagagaatcccagatcagcctatctaagaagctgccaaagggtggggaggaggtggtcttctggtcccagaacagctgctactcctccctgcttcttctggcaaatgttttgtagtgctttcagagcttcataggaatgcggctttgctggcagctgtagggatcattgactccaggtgagtaattctctcctcattgaggggctgggtcaagaaaaaaagaagagttttctccttgacatgccaaggagagcctttgcctgctcagtcccctaggctgtagaagagaatcaaggtcactctgggtttattttttcctactccataagggaaagggctcagggctggtgacttgaattgattagtcactctccggttttattatacctaatataggcccaagcccctagtgtgattgcaatcaatgtcaatcaatgatattaatttttttggtgaaagaccttatgttcttctgtttcacaggccaggctatcactggctttaatctatagatttctcacagaaagaccgtttgtgtcatttagagccccattgcatgcggtccatctctgtgatttttaagttaaattactcattttatctgtggtactgagaaatttaccttaaggaaggatatgtaggacatgaatggtcagtgtgtggagtggaattgaggcagactgccggcagaactgcttaaattcaactgtcacatcaccctgctcttaattctgttaacatagcccagagaatatactgttttttttttccattttgtaaataatgttcttcgaggataaataacaatctgcaaaggaataacacttctgtagatcctaaaaagattacaaaagaggcagcaatacactgtagatctccaggtgatgtaacattgttatttatgtcctctctgaatttgctaagagtcttagtggagacagagatagagccagaaacaacgtcaccatctctcagccctcgggaacttcatttgctgtaccttctaccatcatcaactctctttctagttcttcaggaaaattagtttctcattaaaaagtgagggagactatttgctgtaatgtatagatacaaaataaataagtcttagattctagccaattacaattcaagataactttaattaagagcttattgtataccagatactattctatatgctttataggcattaagtcatttgatcctcataggaatcccatgaggtagtttttatcaatgttattctcattttgtatatgtaactgaggcatagtgaagttaaataacttgtctaaagtcatgcagtaaatgtctgagccaggtctgtaatgagatatccctggcctgtaaagccctcacttttaactgtgccatataaaactacaggagaattgttaagttttaaaaaagcagtacatttgtacatgatatactcaaatcagtgaggaactggaaggtagttccaccaagcccccaaggaacatttataatgaggatccaatgtctacaactctcccagttccagtaccattattgttttcctccagtctgtgtcaaagagactttctaatgaaaacagagagaattaatgaattatattttcagtcatttgacaaagccaaattacatggcatgttatatggggaatattagaaactacttgaaaaaataattagcaattcatgaagtgcctgttctgaatagtaaatatttaagaaagattcaattaaattttctagtagctagctttttattacagaatcagttttatgtaaaatatttcaacagcagcatgcccagtgcacaatataggttttggaaccaaccagaacaggaataaattagacatgctattgatattgtgctacacagtttcaaaagggaaagttctctcaaaaaagctagacagttgaagcatttaaaagactaatcgctttgacaagagccctgaccaggaaggtatcagtttaggttcatggaatacattctaggtcatcagctaaaaattcatgtagagacttattttcacaagtttagagtatgcagcttccatctttctataatcatgtcatactagtcccctgccatgccacagtgggagcatgtgctttggcatcacataaatctgattttaactcatggctccatgaggtgagtgaccagggagtgagttgcctaacttctgtaagccacagtttcacaaaactaatggggacaataaaacacattatgcaatgtatctcttatcatcctatgaaaaaacaggcaaaagttttttatcaatatggagaccagtattaaaatgttattagcattgcaagtggacaaattggtagatgaatatctttaatacaaagtttattttaatattcactactctgaagctgaggcagatgaggaagaatcaaactttaccacaggacagagctgataggactccattcaggtcgtaggtcaatccgttatttatagataacaaaactcaagccctgagaggggaagtgacttcctttaggtcaaataactaaagatgtagagcatccctttgctatagaaataacacgtccttctccgtccctaactcactcccactcactcaaggtttcccaggtattacctaatactctaatttccaggtagttatcctctaagtatcttacttctttctaggaatctgaaggtgaaatatctcattacttttccctctcacataagattgtgaataattaaaatggtggtaattctgattggtagtaatagctattcttattataacagtgaaactataatatttttcaaatcagaaatgattcagatgtacctacagaatcttatgaatgacagctctgagtaaatgatattattcaatttaagttaaggaggcttattgatgttcatcaaaatacaaggagaaaaatatctcataaatcagccttaagttactgcagcctctaacaaatgaaccctctatgttcagttcacatcagccccacttcacatctctttttcttatttcattttaattttacatctcacctcctcattcttgctttagattctgacaatttcagtgtggttaacaactgtgactgataggaatcttttcaatatttttggacagaatctggagatatgttaatgatttattagttgattttccagaatctgtttccaccattcttatcttcatatgctttttattattatgtaaaattttgataatttgtccctggtatattagatggtgatgaacatttgaaagcactgaatcaaatgaaagcttagccttcctgccttgccttaaaatatctctctgtattgtgccttatgcggccctgtgtattagtctgttttcatgctgctgataaagacacacccaagattgggaagaaaaagtggtttaattggacttacagttctgcatggctggggaggcatccaaatcatggtgggaggtgaaaggcacttcttgcatggtggcggcaagagaaaacgaggaagaagcaagagcagaaacctggataaacccatcagctctcatgagacttattcactatcatgagaatagcatgggaaagaccggcccccatgattcaattacctccccctgggtccctcccacaacatatgagaattctgggagatacaattcaagttgatatttgggtggagagacagccaaaccatatcatacggcccctggcccctccaaatctcatgtcctcacattataaaaccaatcatgccttcccaacagtcccgcattaacccaaaagtccgtagtcccgtattaactcaaaagtccacagtccaaaatctcatctgagacaaggcaagtcccttctgcctatgagcctgtaaaatcaaaagcaagttaattactttctagatacaaggagggtaccagaattgttgtaaatacacctgttgcaaatgggagaaattggccaaaacacaggggttacagggcccatgcaagttcaaaatccagcgggccagtcaattttaaagctccaaaatgatctcctttgactacaggtctcacattcaggtcacatgatgcaagacgtgggttcccatggtcttgggcagctccgcccctgtggctttgcagggtacatatttattacctcctgactgctttcacaggctggcattgagtgtctgcaacttttccaggtgcacggttcaagcagtcagtgaatttacaattctggggtctggaggatggtggccctcttctcatagctccactaggtgatgccccagtagggactctgtgtgggggctccaaccccacatttcccttctgcactgccctagcagaggttctccatgagggccccacccctgcggcaaacctttgcctggtgatccaggcatttccatacatcttctgaaatctaggcggaggttcccaaacctcaattcttgacttcagtgcacctgcaggctcaacactatgtggaagatgcaaaggcttggggcttgcaccctctgaagccacagcctgagctctacattggcccctttaagctatagctggagcggctgggacacaggacaccaagtctctaggctgcacacagcacagggaccctgggcccagtccacaaaaccactttttcctcctgggcctccaggcctgtgatgagaggggctgccatgaaggtctctgacatggcctggagacattttccccattgtcttggtgattagcatttggctccttgttacttatgcaaatctgcatctggcttgaatttctcctcaaaaaatgggtttttcttctctgctgcatcatcaggctgcaaattttccaaacttttgtgctctgtttcccttttaaaatggaatgtttttaacagcacccaagtcaccttttgaatgctttgctgcttagaagtttctttggccagataccctaaatcatctctctcaagttgaaagttccacaagtctctagggcaggggcaaaatgccaccagtctctttgctaaaatgtaacaggagtcacctttgctccagttcccaacaagttcctcatctctatctgagaccacctcagcctggacttcattgtccatatcactgtcagcattttgggaaaagccattcagcaagtctgtaagaagttccaaactttcccacattttcctgtctttttctgagccctccaaactgttccaacctctgcctattacccagttccaaagtcactttttgggtatcttttcagcaatgccccactctactggtaccaatttactgcaataatagtctgttttcatgctgctgattaagacatacccaagactgggaagaaaaagaggtttaattggacttggacttacagttccacatgattctggagcaaagtcagcaacattgtgagcagaggtagcagcaggcctggtcttgctgccttctgatggaacaaaacgcccttatttctgtatttctgtggttcttaagtaagggtgcacaccaaaatcttctggaggaatcatttgaaaatgcaaatgctcatgacccaccctaaaagatttggattgggaaccactgcttagttgaatttgagattctatgtgtaaactagaaatgtcagaaagggtttattacttttctcagatggtgaaaaaattacgcatatgtattgggaaggaagagattggacttaatgtggtgtgatttgcaggaaagatatctcagaccaaaaatatgttccacggaccagccttccacatttctcaaaattccaattattagagtcattcttttggacttcttattagaaatcacctgttcaagtctatattataaattaagtaatgcattaaacaactaattaatactttagcacagataagagtgggtctcaccttaatcccaagggaaatgaggcacatggcaggtaaattatttttgatgagtgtgagacagttgagaggagagttttgtaacaagggtagtggttccttaacaaagcaaagcgagatgtagcacctctgtaaaaggagagaaccctaagggcaccatgggaggggagggggttgaaggcaaggtacacttctgccagaggttatccaattgcccttgatgaagggagcctgcttttctctcttacaggatcaagtctctcttggttacaatgaccctccactgaccctggttcatttaaatgcaaagcaacaaaaggggaaaggctggagggatttaatcctaccatttaggctacatagtattaaacagctgattgatttggcccattcagtgaagagaaagcacacactgtatattcaaagcaactgttcgagtttatttgggaaaacagttaaaccatattagataaatggagaaacgactttctcaatcttttttgcaaatgccattttctgtttgctcacctgaaacttagccagagttgtggagccttctaagtcctctggtggataggagaagtgacttcgggtcaaatattatcagaacctttcaatatgttgagaatgttgaagtggtagcaagcacaggatcctagtctgaagggaggattgaggggatagggaaaatagtcatgtagatttggctgttttaagttaactgacaaatagggaaatggtgaaagttctggtcatggctataaaagaagttttggtacttgggacattagcaaccacgaattctactattccttttatctctctagatttcaataaagcccatttgtccacatatccttagagcagcatatagttaagagactgtgttcccttaaaaatgtggttttgattaatctgcctttggattatccagttgctctttggttggataacttgagccttggccttcattttttttcttttttatatttggccatctaatagagggattaaagcacatatcagatctaagcagcaggatttgaacaaagccaaatgcatgaactctctttcttagtcctccccctttaaagttagcatccattccttaaaacagtaccaatgttttcaattaaggaagccagttgaagtggcatgagtgtgcaccactttcttaaaagaagctcagaagccagaacaaaagtcttggcagataatatagtggaattaaaatctagtcactatagatttactggaaatctgctcaaacctccccaagccccctatatcttaacagtcttgatggcaaaggaggatggagtgactttttaaaaatttttgaatttcttattacactctcgtgaacttcaaatctgtcagccaagtcatgaaattagttaggttttttccacctcctctggcttaccagtttcttcctgtaaagttcagtgccatgtccctgtcgtccttggaatgactcattaatctttcttttatgaccttttggtatggttgattcacagattctactttcacatgttaattcccttagcatagtggttctcaaagtttggcctcttgactagcagtgtcagtatcacccagaaacttgttagaaatgcaaattcttgggagccactccagaaatagtaaggcagaaacaaacccaagtaggagtactggttgggggagcaggcaatctgtgttttaacagattaggtatttccgatgcatgcaccagattgaagagtcactgcctcagttatagcccatcctttgaggtgcttctttgttgcttcattgtgcatattatcctcacttagaaccaggcactaacatgagaaaatcacgttttcattggagtttcaaggtggtttggtgacattgattcctgacactgccccaccaaccatgtgtgcacacgcgcaagcacacacagacacacacacacaaatttaggaaataaaaatattaatcattacttgaatattccaggaaggggatagtgagctgcatatctctctcccactgggtgaatcccaggaaagggcaaaatttccccatgtcaggcatataagtttatatagattatccttcagattaagttcttaggatatatagatttgaggaaggtatttaagactttccttcacaatgaaaatatactgtaaactatgaaagcatgtcttcgcaaattaatataagcaaatatcctgagtcttctactcccacaccataaatccctaaaagtttagaaatacatgtagaactggttttgattatagaattaggtacttttccttgttttgcatatgtatcctgttagtgaactggaaacttaagctatttgttccttacatcttaatacacagtagagtagcattttgggggctgccttcacaaagttcctttttggcaagttggtgatggcagcttagtacaatggtttggagtactgtaacagcattctgcagtaaatttcccagtgctgatggcttagaatttgctaaatgtttctgcagaactttcagatctggaaacctgggcaagatttctcagaaagggcagaagttaaggatggtgatgtagaaagttgtaggattccctctcctgatagaatttacgtagtgagatactttgcagatgatttgaggacctttgttagtctgctgccaaacagactaactggtctcttccagccaacttggtcaatttaataataaataaaccttgtcaatccagttgtttgactaggttgtaagttaactcttggttatttaaaacactggctgattatttcactgaagacacatagcctcaagatacagcctaagtttgatatattcctattaagaaagtgaggaaatattaacatctacaagccacttgcatacaattttatatatttggtcaatggacttcagattaaacataattatttgagtcacaggaagcaaacatttataagttagtatatttcacctacatttcttttaatctgagcccaagttgactgaacccaggttcgctgtgttctggtccataatatgtcaagtggatatgtcaggtgataaatgttcttctattctttctgaggctgggtttcagtatttacaagggaatcctcagttgtaattggctccttttattcttatttgaaataaataaaacctagattaccttgggaagctgagtagtgtattaccgtaagcatgagctttggaatcgctgagacctggattttaacttttaactctgccactttgtgtgtgaccttaggcaaattacttaaactctctgagcctcaggttttctcatctattaaattaagcatgataatacttacctcacaggacatagtgcctggtacataagaaatgctcagtaaatgttagctatcctcttgcaggcaaaggacttaagttgcatttgagaatctaatcttaattaagaggcataaacatggagttgcaccagtgacctggaggaagtaccctgcttgcctttaccaggtcaatcatgagctgtgggtatagatatcacataagatgttgaacagaggggaagagagggaaagggccttaggttgcctctctgtgttctgatttaataacaagtccaaaaggattttttattcaatagaggaaacaatactaaatggtaagatggaagtacataattttaatggaagaagtaaaaactagagttaggagaaataggaaaaacttcataattgaactagaagagcataaagaaataattgtaatacaatacatactgtaagaaatcttattaaggagctacaagtgacagtgggaatgtgagagagaaagaaggagagacatattgaaattattctgattgagaagattcggggtgaggcagtttctgaaagctttatccttagggcctctcacctcctctagctgggagacaagtctgcatttgcagcatacataattgattatctcctcaggtgatggtctcataaatgattctctttatctctaatttataaaacaaaagaatgaagtgaaattattggcagtagggacctatagatatttggagacagtaatattttaaattttgctctgacactgacagaaagatgagatccactaaaccactgtagatgccatatattatgtgaaagataaagtatgtaagatatcaactcatgcttcactttttaaaaccactctaaagtaccttacattaagtgtacaacaaattttctaaataaactaaggatcagtaggatagtctctttatagttcttagacaatcaacaatagttatagttttcctgtaaggaaaataatttttaccttaccaatttcttttcaagtttgatgtttatcaaccacactcaaaaggaaaatttgtggttgtaacatttttattgcttctattgatcagtttcctgtaatcgttccttctttgattaaaaaaactcttctgacagttttgctaaatcctttaatttatattttatgaaaatatatctaaatatgttatttagttacattaacagttgcttacaacaaacttgacaaccaagacatttaagagaaagctctgtgaggaagtgcctatgtacctaacaaagaactctcattagaatctttgtccttaaaggaattctaaattttggggctgtgtttgttcttcacttttgccacttgatcttcaatggtatgtaaacagtctgtaataaagtgacactaatgctccttgaatgtcatgaaaaatctcattttagtttattatgtcatagggttagtgctcatgtatgtaagatgctaaacatctgaatatttgataacatttgaatgttatagcatcatattgttattgccaatgtgcatgctattttagaatctttatggatgcaacagcagcagaaagcaatatcaatatttagtatgcttgtaggtcattccaatttcagtaaaggagaagaacataatataccaggctaaggataccactaccacaggaccgctgactgtttagggacagaaatagggacctcaagaccacttaataaagattaaagggcctgattttcttaggtacagcagtatctaaacttctctatacatatatatgagaatgtttcgaatagatgctaatcaaatagatttgatcagtgagtgggtttttgagggtcagttaagaaagttatttgacccaacatgtagtgaaaggaagtattgtataatgttttaaaaacatgggatctggggtcagattttctggatttgtatcctgattgtgccacttaagtatctcaggcatgtgacctctcaattttttcatctgcaatgtgggcacaatgatactctttgacctatgggatagttgtgaaagttaactgagtttgtcaatgtaagaggttcctagaacctgttacataataagtcatccacaattttgcatttatatttatcactgttattagttacttgagtctaatggctctttgtcctggagtaattttgagacaataaccagcatattgaagaaatttcaattgattcattttctttcttaaacaatcattattttttattgctctattctactattaagaaaatagtattgctgtataatctctgattagaatcacactcctcttaaaatatgggctatcagttaagaagcaaaaggttggtacagatccatgttccacattactcttttagccagttacccagcaaccagatgcaaacaatttataaattaaaccccaccttttgtcagaagatttgaggcaatttgtaaagttaatatgcattgctgagatcgaggtgagagatcagaaaccaatcaggagaggaataaagataacgatcccaagaatctaagatgcgaaactgaattcagttgaataataaagatcagattttcctggcatctgaggccaaataaacaaatacccaaaacctatgatagtatttatattaatttgcagagaaccttatttcttaaagaaaaaaatccccccctttttttttgcagtcagatcttgattggttaagccaattcaaagggacccttaatttactgggggctttgttacacacatagctaatagcatgactaagaaaataaccagacaaatttaaaaagctatttccaggcatttgcagacacgtgggcacatattcagcagggtttcacaaatcttctgtgtctataatcaatagttaaaactaactctgcaaaatgtgcgcataaacaagatttccttttcatcttccttcccacttttttccttctctctctctctgtatgtgtcttctttctctctctgctgtttgtttgcttgctagtatccatcccttgcatccctggattgcccaggcctgtcacctgaggaaccctacctgattgaccaagctggctgatgtatcctactgttctcttctctatcttctctataaagcagcaaataactctagcattttagaaaacttttcagcaaaaaatagggcaaaaagtgtgttttagatgcctcttggttaagttaaacctttagtcaaatagaattttccattaactgataagtcctttaccagcacagtcagtataataagaataaagtgccatctgatgggattttctggggtagtgagactattcttcatgttgattgtggtggtgattatgtgactgcatgtgtttgtcaaaactcatagaaatgcacactaaaatgggcaaattttactgatgtaaattgtacctcagtaaacctgaccaaaaaaaatgtgtaccatctccagtttttttttttttttacttttttctattataaagggagagacttgaaagatatgtggatggatgaatggatagataaccaaaatgctatagagatagaattgtgtagttatagaaaagcactgagacttagaccccagaggtataatttcaggctcacttatactgccagctgtactctcttctcaaagtgtcaccagtaaggttactttccctttctggaatttgtttctgcctctataaactgaaagcattgcactagtatctgattaagctcaggcaattcctctggtgaggtggcctgatttgggggaagggtaggagggggaagtaggcagatttgcttgagtgtcagaaaataaatcatctatcacaaaaacaggtggaatggataatgtcatgtgaaatttgagaaacatctgttcgcctatattagtgtctgggtcaagatggagccacctgggttgaagtgatgtatcaggttgccaaaatcagtgtctagttgacccaagatgatttggccagtgtaaaacaagactgttatcagttttacagtttttagggttttttcactttctttaatttctggggaattgttattttttggagctagctggggaagagggaaagttaattaataaagttaatctcagtgtaagagaatatactcaccttaaaagagtaaagattgccttctaagaagagtaggtattattttctaaatattttactgtcttgctttactgtaattgcttgctcaaatagatctctttcagttagataaaagagaaaaaacctggatcattgattgcataaatacagaatggggaagagtaatttgtttagtaatattgatatgtgctttataacataacctgattatgtttgggggagctgaatttccacttccaagcacaaacagacctatatagaatagtaaaattgctaagatgatgattttgaaagagaaataataagagccaaggtaaaccatgttctatgatggaccttggttgttttcatcctgcaaggagcatcaataaatgaaacctgccagataaggttctccagtgataaactagactactcttatgccaatgacttgccaaattattgtatatagccagtatctgcatgattttatgattcataacccaaaaagggtgtgtttaacataatatgctgcttgaacctagaaatcagcagcagctgagaaatctacatttcagaaatacactggaatatgttcctcaacagagtgtgtggaagccaggcttttaatatattaatacaatgcttttggaaaatatatcacagctatccccagtgagagatgactgctttttagtgttcacttaatagccacacataaatagaattctttgcactaccttatgcaatgcctcctcaatcacatgtgtattggggcagggagagaaaggggtgcagaagccttttgaggaggcagatgtgcagttggggtctcttgccatacagaaagcttgaaaagaataataaaaccagtcaatggtaattttgtaatagcttagatgaccctgaaccccttgaaggtgaagtccttgacttaatttgtttttgaagctctcacccagtaccttgccttaaatgaagtatctctgtttggctttgtatttttttattgcttgctatgtgtcgggcactatgctacttctttcttgtaggttatctgttctaatctctaaaacaatcctgtgagggaaggtatcattattccccttttacagttgagaggtcaagtaacttgccttatagtcacagagttagctaatgataaacagctggaattcaaagacaaaaatgcttttttaccataccagagcttgcttcagtgtccagagattgaccatgcattaatttgtacctttaatatatgagtattattattaaaatgtatcttttcaaaaaattttttaagactagaggaaattcatatttaacatctccacagtcattatttaacttattttcatttaaaaataacagctttattaagatatcatttatataaccatcaccttttaaagtatacagctcagtagtttttagtgtatacaaaaacagtgcaaccatgataactatttgattccagaacattttcattacccacaaaggaaaccctctaaccattagcagtcatcccccaggccccctgcccccagccactggcaaccattaatttattctatggcatattctggacatttcacataaatggaatcatacaatgtgtgacattttatgacaaactactttctcttaacatatattaggttggtgcaaaagtaattgccattacttttattggcaaaaactgcaattacttttgcaccaacctaatagttttcagtttattcatgtcgtagtatgaatcaggacattattttttcttatagctaaataatattccattgttattgatataccacattttgcttatccattcattcatcagttttgatggacatttaggttgtttcagcttttgtggctattattaataatgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaacaactaataatgctgaacatctcagttgcttattgggcatttatgtcttccttggataaatccattcagatcatttgtcagtagaaatccctgataagatatatgatttaaaaatattttctcccactctgtgggttgtcttttcactttaattttgatgatgtccagtttatctgttttctttggttatttgggcctttaatatcatatataagaaatcattacctaatccaatgtcacaaagatttactgctatgttttcttttaggagttttatagctttacgtcttacagttaggtagctgatccattttgaggtaatttccgtgtgtggtagaagggaggggcacactttattttgttttgcagtttgccccagctccatttgttaaaagacttaatctttatccattgaattgtcttgacattcttgttaaagattaattgcccataaatataaatgtaagggtttatttaatatattttcatcaaattatgaaaggttaatattgttaattgtgcttaccatgaatttgatttaaatttttgaatttcagctgggcacggtggctcatgcctgtaatcccagcactttgggaggccaaggcgggcagatcatgaggtcaggagtttgagaccagcctgaccaacatgataaaaccccatctctaccaaaaatacaaaaaaaaaaattagccgggcgtggtggcacgcgcctgtaatcccagctaatcaggaggctgagacgggagaatcacttgaacctgggaggcagaggttgcagtgagccgagattgcgccactgcactccagcctgtgcggcacagcaagactcttatctatctatctattgatctatctatctatctatctatctatctatttatctatatctgagtttcacataaaacaagatggtgataagatacaaattgtgcttagttgctgtaaaacagttattgaaataattttgtcatcaaggaagcaacagtgaatggtttattactttgaaaataaatataattgagtctttatcataataaattagtattctctactacagcctaactttaactgtgaactagattactcaagagctagttttgaataaggtaatatataaatgtcatcattcattggctgccttagatgaaatctaagaatttttttacttgttagccactaaaatttccaatgagaaaaaaaaaagccagccaggaagttatcctacacaaattaaagctaatcataagacattttgaaaaataaaaataataggaaagtcatcatccatttccaaaatgaagaaatacattttcaggtctctgaagttctttcttcctcatgattttattttggttgagattatccagagatttccttcaaataatagcaatggacaacaaaatattttggtactatgatatggaccatttgatgtacaaactatatagagaatatattggttttgaaatgggtgtgtttgtgactttaactttccaaagtcaatatttaccatggatgcaattagtggctgatgttaaaactaaggtgacggggcttgtgcttattgtgctcttaatggtctcagcaagttgattaaatttgtttccagtgggcaatacacttgaggcaaagaggccctgcatagagtttagcaaatttatactttaacaattcttaaatattccatatcatgagtggctggtttgagaattaagattttagtcactaaaaagttagaaagtagcaagagaagttatgtactatttatcttctagacaggcctgagagaaacaaaaaacaatattgtataaatggtggacaaggaataatacttaagctgtgggatggtatggtatatgatttttatgaaacctcagcccaggcttttgcaccaaattgattgcattttctgaaacgcaagaagtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttctctcagcttaacaacactaatgcctgcaaactttcctagaaagattcattttccattactttaatcatttctgttattctctgtagaagagtattcttctcttttaaaggtaataatgctcagattgacttaagtggagtttcttcaggagattttgcactttttatacattttgtataagagaaggagcctgacaatctcagaattctatctaagagacttccatttcttacactgacatttctcagactgtcatttcccatcatcttatgtggtaatttatgaaaattctataagcaaggcttatgccaaagcagttcccaaaggcttttgctgttggagtcagtttggccatcaactcatgggaatgacttgtttaagtcactttttgtaagaggataatcttccaagctttatcttatccaaagcaattcagttgcatgaaaataataaaaagttgtaattcagatggagacataaaaatttgatttaaaagacctttttctattgctatgactttatttggaatgtataatgcagagatatgctgagtttaactcatataatgagaggcagagtgtacacttgtaaatcttcatagaaaggatttcacagctctcagtgctgcttagtatcaaaaatctaaatgagataccaactaaacacagatatttggcctgcaatattgtatagtacatctagttaccctgaaaacatagggagaggtcttgagatatctgtgggctacttcactattacaacttgccaattctgtaaatggactcactctatttattaggaaaatctctccctcttgtttgagctggaaatttctaaatcttttaaaataaaaaaaattaatgaacaaactctgaaataatcaaatgcaccaagtagaggaagaaatcagatctttccagaaaatcactgtttgttttaactggtagcaaagatggatcaaattgtaaagttaaattaatatatacatcttaagtaaaacacatacacatacacacacacacacagacacgcacacatatgtatggttctcaatacttgaataattttatgatttaatttggtgattaaacttgtcaggagagaaaaactagtttccctttggctttctgtaaggcaagacttggtcatgtcccagttaatttgggagaatataactaggtaatttagggtgtctgaattttgcagagacaataggtaaacttcacagagtttaggcaaaaaggattaatcagatgaattttcaggggaataaacttttctcttctctctcctctcccttctctccccttttctctttttatcccaccccaacagtttgggctggaagcagcttacagcaaatcagcaccttagcactcttaatatcacccagtgaaaagcagggttctattcttctagccatatacacaactctttatgccccccttcaggctcctgttggggattgtattttcccttcactattgcctttgatgtttattttaaactgtgaatctctcctgcatttaaatacttgttgcaccccttagcagctgctgaaacgtattgcaggggttccactctgatgagacaattataaaacaatctcactatctcctaagcccgcacctggggtggtgggttggggatagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagcaaaaaaaaaaaaaacataaaagtcagtacacttttttcatggatcggttttaatctctgttatgaattctcaaataagtgttttttcttaccttaaatttatttttattagtgatagaggaggtttatttcataaatgaaattaaaaatctattagaatatcagaacttctgtgcatatatgcctaaaatataccctaaaactaagtgaagctaaattgatagaattacaaaagacattgatacttccataatcacagactggaggactttaacatctgcctcggaatgttatagatcaagttggcaaaaacctccataagaatgcaattagcaagcttggacccatggaaatatattgaattctgaatcaagagttagagaataaactaaaaaataatcaaggttagaaaataaaatgtttcttatgtgctgtattcttttccagcacgtaagggacattttgaaaaattgattataatcttggctgtagagaaaatcttaaataccaaagaatccgtatcctatagaacatattctctgaccaaaattcaatacaatttagaaaggaacaacaaaatgataaccaaaaatccttaagtgtttagaagttgaacacatacatgtctgagtgatttataggaaaaggaaaatgttaatgtgaactcaaaaaatgtatttactttattggatatttatctaatgcattaatacttttgattaaagaggaaaatagtttttggggcctctcacacatatcaaatgataagattaaacaaatagcataataattcataaatatttgtgggggctttttaaaaagtgttgttgagcaaattaatataatagacaaaattgtaaaaagattatttaatctatttaggacaacatttttttttcaagttctttggtagccctagattttctatcacacacttcctaacacagtgtgttgcagacaggcattcagtgaatttttgttgaattggttgcagtagaggatagtgaaaacatataccttggtatagtcttgatgagttaattaaaaattattcttgctcaatcaatatactaggttctctaaggttctctgttaggcagcctggatgaatatattgaagttgcttcaatttagattttaaattaattcagattgaccttcctgataatactgctaaataaacgaagcataacgtaattggttaatcttttcaaaaagacaaagtaaatctcaaagccacatcccacagatactctcttgcctcggtcagatgtgggtgaagtatcttctctggactctataatctgtcatctaagccagatggggatacatggtttttgaaactgattagccagggtgaacttgctaaggttatagatagaccatctaaatttacttctaattccagactaagaattaggtcccagttcctgacttatacaagcccaaagtgaaaataaatttcatcaaacatatttttatcttttaataagtttgagcattgtccgagtaacacataaatggttaaaataatatttagactgcatttgtgcctgcatttgaattcacagagatatttataggtgaagctctctcttcccttttgcataaacattaaaataattcaatcagcttgttataccagatattttcgttatatctcccaaatattagcagtttgttccataggatttaatcatggttccatccagaggcttattattatagcagtaatttatggcaatgaaatcaatttgaaaacatacagaacctaagaactaacaaaatgtagttgttatgtgtgaattaaaatataaactgagaatttgaaaatattcaaataactagaatctctctaatttggtagactgctgacctggatttgtgaaacattttcaataggaaaatcttaaatatcattctaatactttcaaagaccttgtaattttcacttgtactcttactgtgaaaattgccacattgtctcttgcattgtggaggtttgtgtaactttattatctatattaaaaattccttaaaaataaaaactataactaatttttatatttccttgctttctacatatcatataggtagtatttaataaatacttacatatgcaggtagtgtgaaagggttaaagagcaccagggtcttgggcttagtcttgcctctgctactacctctatgcctttggacagtgggaatcaatgaatttggaaaattagtggtggagaattcagcagaaaaaaatggtgaaactatttgaaggaggaaagaaaaaagtcaaagttgtgagcaaggtaaagttggtttctacgtgcttccatgatcctttagatcgctttccttcctttcctccaaatctgggaattgtcattgctacacatacacactgctccctccacgtactcctcctacatgcatgcatacacatatacacacatttattgaaacaaccagataattgttataaatatgtagttttatctagacgattgccttagtcttccatattgcctcgctagatttcacttgcctacctcagtgacttttatgtttgggtagccttaactcaaatcttcctgtagttggattctattattctgtgcaatagtaccattctacttttatcatgttgcatttttcagcttggcattctttgagtggctatatccaccatactttccccccatccacttcccccgccccccaccactctgttcgccacacaactgtaagggatatattgaggggtttaactctgagactttcagttgatttcacactcttcatatttcatttctgcaggctttaggtaaacagcatgtcataggcaaatccagcattatagtagccaaaatgttctgaaattccgactgccttggtaattccttagagttaaaaaacactctcaaaaaagcattaaatttaaaaactcaagttcgtaattaaaaaaaacacacacacacacagccccagttaaaatgcacatgttgtaccatgatgagaaaagaggtcactggataagatctttgcaatacattagtatgggaagattagctagtgctttggctttgcaaaggccaaagccagatgctgaaggaatgggacagcagggtggaatgttgaggaagggaatgtgtgaggcatggagtttacccataaaggtcaattcaaggcaacagtctacatgtaaaagtagttttcagtcaacttaggggctacaatgaggactcataccttttgagggtggcagggcctggaagttagaggtaaattgatattgatagaagatgtccttttgttctctcatgtctatgtttaaaagcattgactagaccctaagggccttgtactatcttaaatgtaaactatgcttttttcctcatcatcatctttctccagtctttttctactccctgctgcttctctcattttctcttctattctttccttttctattttccctcctccttggcatttcccttattcttagtagccatcccagtcaacttcagtgcttctaaagtgcctttgagtactactagttactgctatggtttgcagagacaattcagtttataaagactttttaaaaaatgcatcaacatcctcttcacctcatctttatattaagggctgttgtgtttgtacctctgtggacacacctggaaaagttgagaattccattttgactgtgtagattttaagacaaagttgcttcttttggttgaacccctcttctcagtcatcacccatctgtctcagtgcttttctttcaactagttgtgctgtttgatagaattggaaacactgcagcttacatctgtctgagcagatggaatgcattttgcatgagtgttaactgattcatgcattacataaagaaagcaatctgtgttaaaacattgtgacattgcaataaagcactatctgctgtatgctgaaacctgtttgcttacggagggttttgttgctcttgccataccctcacccactgccccatggttaagcccagacaaaccttaaaaggaaaaggtatacaatctaccatagtgggagaaaatagtaactgaaagaaaaaaaatcctgaatatgtaagtcattccaatagatgagttcttttttatttttgtagtgtattgtcattcggagggaaaaaaagagaatgtcattgtggggaagcttcttacatggagaactaaatagtcatcaatcacttgatcatgctttccatatactttggtaaacaatgctgcttggaagtgttatcagagggtttgaaatagtgtgggccctagtctcatggagttcctatgtagtttcctcagcatgtgcagttatagcctgtgactttaaatttgaattagtgaccagcattgaaggttttatggtgtcacccatttgtaacagcaagcttcaatggctttgtacttttgtcccctgtagatctggcttgccacatagcagtatgttgcagtctttccttagttgcctactagtagctattcatttatttcctgcaaatgttgtatgtatcccacagccaagaacacagaactttattgtccattttgtacaattcgtcatttgagtgctatagcgtaatagagagcagctctatgtgcaaatgatgttactatgtattttgacctattgtttccctgcaggagtaataacaagggcaataaaactcagtcaaagctgctgtataagcacacataactgcctcaaattacagggcactttcaaagctacaaagccactgaaactacgaaggctgtcttctgactcctttcacagttctaataagcatgaccatgactgtcccagatttctggaaggggaaaaacattattctgttggattattctggtgattctgtagctttttagctacaaaaatctgtttccatacaaatcctttgactacatgtagcaaaggtttgggtaatttaggggtatgttaagaaaaaaaaatgtagaagtaaagaacttagagctagctctcactatcacatgtccccatagttgatataactacagagggtatcaactgcaagtatttagtgaagatttcagagtagtagccacaggttaggggaagcatggatgaacattaagtaatgttacctgacaaacttttgtcaatttggcaagagccttggcacttcgattattttgtgagctcatgccctctgaccgtgactagcttcttcattgaggccctctgactgaatagagttgtgaaaaattttgggtggcatcacagtgcaacctagggtcaatgaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatcttaaagtgtcaaggttaaaatagtatttattcaactccaggatccatctgctgaaagtcagaaatatcgactcctgccagttctgagttttctccaaaaggaaaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaatttaagtctcaggtgaccaagacactgacaattcataactcttctttacaattattgggtaacctgtatttgattctgggtccccagtgtaaaaattgaccttgcttcattacttttgagatacaactaaatttggggaatttggtgtcgcatgaatgcaagtccttttgtaaagtagaaatgttttatgactgttcctttatttgctttgttatgtttaacaagattttcctgcattggtttttgttaaaagcaggcacatatacctcttaacaatgccctgtatgtgagcagtatcttaaattcagggacatgcaacatattcttttcgtaggacagatttgaaatgctaatattaattttagagtcatgaagaacaacagcaccgtaataaactaggtttttcccaggggaagtggactaaatgatgctgcttatttgattatctaagttaattaattaagaacacaaatccttgccaaactgaaatcaacacattaagggatatgtattctccctggatagtttgaaatgatactgcaaaaagaatatacgttcatcttaattactatattttggaatgcaaccccagaaaacagatttagttgtgtcagcataaattaatcagggaagttttttaggactttatttaagtccttcacatggtagcatatattttttctctagaactgtttaaacatactgtatttgagatccaataatttatgttaataactagcctttgcatttggttctattctctaattgtttctggtgtatacatcttacaaactataaatttctccaataaactgtgaatagaacagtttatctttccaactctccatcctcttcccctttttaaaacttcattcactttttgaaattccctgctcactcatggtctcatggtttccctgctctccattccagaaacctgcttctttcaatatggctgaagaacaaccccttctggaactcctcaggctccagccttttctttactccaccttctcattccatcagtacttaactgttcattgccactgttttagttacctcatctgatagtctaactcatgcttaaatgttagtgacaaattaatgtgtccttctcttagctaatattgagtttcattatcttaataacatggaggacaggacttaataaataatttttataccttgttgtaggttgtggagtacccggaagtattttgaatagttgacctattgccccccaaatcaataactgaattattatttattattattattattattaactaaacttgaatgcgtggaatgagtttgacaacaagacaaagagttttcttaagtgaagatgatagacttcttgattctaaatgccaatagacttgaatctagagtcaagaatgactacaaagcattgttactacctattgtcttctgttcctcaaatacgaaagagcctatgaacttatacaaagtatttaagcagcagttgcttttacgataagaatgagagctaagagaatttttttctcctagctctgtgatgcttgaaaattatttaaaaagaaagaaatgctgtcatttgtgacaacatggaagaacctggaagacattatgttaagtaagataagacagacatagaaagacaaataatggatgatctcacatatctggattctaaaaagttgaactcatagaagcagagagtataatagtggttaccagaggttggtggcagtgggggacaggggattggggagatattggtcaaaagacacaaaatttcagttagacagaagaataagttcaagagatctgttgcacatcatggtgattatagttaataacaatatattgttataaatatatttactaaaagagtaaattttaagtgttttcaccacagaaaaataataagcatgcagtgtaatgcatatgttaattagctcaatttagccattccacaatgtattcatatatcaaaccaccttgttataaaccataaatatatacaatttttatttatcaattaaaaatgtaaaggtcattctttgtactcaaactctagttaatgaagcattattaatcttgtggagctagtggctcctgtatgatactccagatattactgataggaaaaacagcccaaaaaatccacatttataatttactactgttcttgtgattttcctgaataatattcactgaggttaaaggcaattgtgagattatttaacactcaatgtagaatctaaaactaaatttctttcttaacgttctaaaactaaattcctttcttagtgttcttttgtgtgtttaacacaaatgttgttaacgtaatttgccataaaactcacattctaactgaaaaagggcacatcctaaaaactggattcataggttctagttcagcatctcatttatgacaagtccttcagctaagatcgcaaaacagcttctgtataatcaatgaaccacaagatggcaccactgaacaattagcttatctcaaggtggcttctaggttctctagataggtgcccaagaatagtgttatacttcttcaaaacgaacatcagtcacttaatcagtcacttctggtgaatagagtatgaaagggaaaaataacaactttatagtggagaaacctggcaggttgttaccttaaccaagtgctcaaggttaatatcaccattgatcaacatggagatatcatgtacccctgatatgatgtgatgaaaagggcatttcacttctgtgatatccttcccaaaaattcacataacctcaatctaatcataagaaaacatcagccaaacccaagttgagggatattctacaaaatacttgaccagtactctttaaaagtgtcacagttatgaaaaacaggaaagactgaggacttgtcacacactggagaagtttaagaagacatgatagctaaatagaatgtaggatccaggtttggttctagaaaaaggacattagtgagaaaactgggaagtcagaataagttttaaaatttagttaagagtattataccaatattaatttcttcattttgacaattgtagcatggccatctaagatgttaacattggaagaaactggggaaaggatatacaggaaccccctgtgctatctttgaaactgctctataagtctaaaattatttcaaaataaaatttttgaggagtcaaggtacagggggaactcttctgaaatgctctcttaacagtagcacatttctatgatctattgtctgtatatgccagacttctatggagtcttgtagaatgatttggcatattaactcagtacatggttccgagacctggagttttattcctctgtaggttcagtgagcatatttttcaaacccaatattaggacacattttctgacgaaataacttcattcaattttcaagtgtgaataaatcacagataatgagggtagaaccaagctgattttttttctgttttatggccatggttggaatcttttaatgacattcagttgtctcactaatatgtcataatctattgattttagacttcaaaaattttgtattttacttatcatcagttaaataatgtatggctaatatttttgataacctgataaatattttgtattgcccaaaataatagtggctcataaataatctcttagaatcaaggaaggaagcattgtaactttttaaagggatgcatgcaaatcagtttccaacatgttgtatttgtgcatacagatgtggaaaaaattttactagcaagtgttcgtgtgaataattatgaaaacaatgcttcctaagttataaggactgaataaataaaaatattaatatataattcctcccagagatgtaaataaatttgaagggtatccaacatactcaataatttttataaactcggttaagttcaggtgtcattacaatcctacgaaaaagaacagtttaaaactgttttattataactgtccagcaaaagtaatctgactccatccaaacaggctgccccaattaagacaagtgacagaagataacacaagctcatgttcttttgaaaaatttaaaagaagctaaggaggttgcaaaaatagtgctttttgtctgataaaagagaaaattgtttctagaacttgatagtattacttcatggattgatccttacaaactctgcctcatttccacttctcatgtaaatctgattttgcctttgcatttgtttcccaagactttaggttaaacagacaggtcttgatcttgggttcctacttttctctggatcaatcaataacctgtaactttttcctttcctttaaaaattctagtcttctgtggctggcatgctccgccctaaactgctcacccaattctggacatttccttgtgccttgattactagtctctgaaccctatcccaagtcaagcacattaccttgctcagtttccgtctttcctgccttgtgtactagtttcttaggtcagctgtaaaaaattgctacaaactggatggcttaaaacaaacaaaatgtattccctcacaattttggacataagaattctgagttgaggtgtctgttgggccattctctctctgaagtctctagggaggaaactgttccttgtctcttcctggcttctggtgttatcaacaatccttgacatttcttggcttgtagttgtatcactgcaatttcttcttgtcttttacatgactgtcacccctttctgtatccctgtgtctctgcgttcaaatctcccttcctttcgtcttataaagaaaccggacattgaccaaacaaatccatatgacctcatcatagtttgattacatctgcaaagaccctgtttccaaataaggtcacattttgaggttccaggtgaacctcaattttcgaggggacactgttcaaccaagtacagcccccagatcaaaccttctgctgagaaatatcagataaggcattctatttattactcatagtaatgttatactgattttttctatgactacagtttggaatatgtctagaaggtaccagccacaaaataggagatctgattccaaacctatgtgttcacctttaaaaattacaaatctgtagcttatacttgcatttagggtaagatctaagctcttataactcatcatattttcaataagagagaattttctagaacttattccttttataaatatttttggttcatatgattcaggacatattaaacagtttagaggctgttgaattaattatgaatcactcacactaagtgatcattatggagataatgcatggctaatatttttgctaacatgataaatattttgtgtttgaagaagagtccagtggaaagatgtctgcatagtatcacataatcaattgaaaaaatgtttagtacaacaactcgttttctgccatcttcaatagaaaattttcacttagattaaatgaaaattttcatttagattaaatgctttggtgccatgcaaacctagattaaagacactaagtaagcaataactttaaataggcaattatgtccactagttactacagatgtaaacagccaaactgttccataaccttcgtcgagtgttttgagtgggatggtgatttctttaaaatgttgataatttaatatttctgttttctatataatactatatatttcatttgtatatattttatattttataacatacaatgtattcgacactaattttaatattttctactttaattgcttcttgatagctggattacctagccagcatttgatatttatcactatcctgtatttcagggacttcatgagaagactggtgcatttacagctgttaaagtgatgaacgctcgtaaggtaatattataaattgcctgtattctcttcccttagtggactgtgttcctgggatacacaactcagaaaatattgtatttgtttttaaatcattattttatataataattattacatcaatctggatttattatagttatcatttaatattacttttattcattagtgtattatatctattactttattatatatccacataaaacaatgcttctttcacagcagaagttccacatattttggtattctataacactgaggaatatatctgtactcctctctgtttctagttgactatttgtttccagggatagcaaagaagagattgcttctaatattgggttaatcctgctgtgttccatcatattattttccctctccaatgatttcctctgataattgaggccattagattctcaatgacaggtagaaggaagagacttatcagaaatgcacatttttcatgtattttctgacagatgagcaaaagagacagtttaattggcaccgttcctggtaacattcataaagttgtgtcacggttcataacatattggcatagaatttgctagcactgatttctgttctttttctttaacgtgagtgccacactttctcaagataatattatcataaacatagaaaaggtcaaaaaaattttacttcactataccctaaagggaaatttgtgtttgaaaagctatacacattgactgaactgttgtcaaggccataaactgtgctttttccaatttgtgcaggaagtgaattgctgaaactgtttaaagagttgtgtgcttccatagcacatgtgtacctatgtaacaaatctgcacattctgcacatgtatcccagaacttaaagtataataataaaaaaagaaatgatagctgaattaaaaaaaaaagttgtgtgcttttagttttgccagtaaatgtcaaaagttgcaaaccaatgtgagtttcgagggattttgatgttttgtagatttattttgccctacaatccatggcttccaaataatcaaacttctactttttgagtgatactctctaaaatacttattttcttgttttaacttaagagaccttgacatacttttaacctacatttcagatactctgacttttaaaatatttaaaaatcatgttcaacccatggaagtttagtgtcaattaactggttttgtaaggaggataaagcactttactaataacaaattgtaattttcccattattacagcagttaaatctactaccatgaatttgttgccaaatttctgtatgtcataagaatttggttttttaaattaaaactattggagaaaattgagagaggaataatgttatcttacttttccattgagtgctaacgtagcttaaagtacttaagcataaatcatttttagagtgtaccagtacatctaataacattttattcttggttacagacccctttacctgaaataggaaggcgagtgagagtgaataaatatcaaaaatctgttgggtggagatacagtgtgagtactaaaagttctcattaatacccaagtagtctttcctttcattttcagcttttaacttatccctttgcattgtgtcattatctctagaagactgctactaaaagtgttcttgcctgaaagtgataacatatttatatcttttaatatattcacttagattcaatcatcatatatgagcactagcatatatcagagagtaggagataggagaaaagggcccttgaataggaatgcattgactgtcagtgaggaattgcgtaaatttacagagcatagaaccctctggctgaatagcaacaaaaaaggaggtgatgcgatctacagcaaattttgcctaaaattggccttggaaaggtccttttcacacgtttatcatgacattctggactaattgcttttcctccattgtgattctaacaaacattaccatcgtgtttgaaccaaatgaggaatgccccacgtgcccacccccccgctttttgtaagagcaatagcaggcagaaaacaaaccaaccacttagcctcaaggtcttcagacatctggtaccatacttgaacacatgaaaggatatgaacatgttttctatgtgcagctttttggcttaccttcagagcagtttttctgataccaacaattctctggctccagaataaaaccaaccaaagataatctctctttttcagtagatattggtgatctataaaatattgtatgggcccaaaagttgaatttttgctcttatcaatataatgaattgatatattttttcctacttttctctcctgcagtcagctatacatgagactcaaatatttctagcattttgtgacttagtaaatatgtctcaggcacattaaaaataacccttttactaacacaatcacattcagaaactttctagttatattagaaagatattactaaacaacctcatgactcatctattaagtactaggctcctgttatgtctataattcatgttaggagactaagcatatccagaggaccagctaaaacagatagtatcatgcttttgtagcttaggaaaccgcaaaagataaggtatggaaaatatgattattttattaattttggtttcatcaaacatttgtgctaataaaacttttttaaagacctgtcccaaaccctctctggcacactttccttagagaaaaggattttgattctagaattggatgaaattacaaaggaagttctggcatccttgagctgcctcctcttgacaaaacgcagggtattcaggccagtctgtgatcaactggccctaagccaggaaatgctgtagcatcatattactggaagatgtgtgagagttttaaattacccacttggtctgatggatataatgtacttatgtgtttctcacaagctcagcttcctgttaattcagagtggcaaacacactaacgcttcccaaacatatctgatcttcatttatttgttttgggggagtttacatttatgtgggcaacccactcttaaaaggtttttctagttggggactttgaattatctgattatgtattttagtaagaaaaaataactgctagctaatcatccagttagtatctctaaattatcttgaatcctttaggataaaaagtatgtgacttgcacacacatctcttagatgccaggggtttatggaaatagcaataatatgtaagtccagaaacatgagttcaaatcccaagtctaccactaaatagccaaaaagtgcttgggaaagtggtttacctttctatgtctcaggttcctcatagaaaaagagacatcacaaatgcaactacatagctgcccagagcccagcgcatctcttgttctttccaggacacataagctttctaactcaaaaagaaaaggaatcaccttaacatcaagctaccaaactagtgaaataattcagtcttgcccctgcttctctttcacttgttctttgtattcttaacctcctaccatcctctcattcctatttattgcactacttatgagttcatattcctctcagcagaaccttggcaacttaattgaaactgagagtgcgtacgcacaaatattctataatagctagtccctgtggtttgctagtcttatgcggtgccaggtattgttactatttcaaaggagggccacatcacaggggaagcagaaagtttaaggatcttacatgacaagaattaaagccacaggatttttacctttctagaaaacagattaagataatttgaagggaacttattaactgaactttgctgggaggttgggatgagactctagcctgagctttcatgcaattctcataccacaagttgtcatgactttattacacaaataaatagaaagagggaacctatcactgagattttcaactgcacatatcaggacctatccttttcccccataagacaaataggtgtctagagatttattttccagtagttgaatgtttataggtaaatccagtggaaaatccttgggaaatactaaagaatgttctgcaactgccagccattttctctgacattgcaaactttttttttttttacgagatataaataccgggcattttaggggaggaaagataatttataactaaaagttaagtcaacttagagacactacagagcctagtgcactgctttatatttatgtcataagtatttttaaagcctagccacattatacctaaatatagaaagtagttgcctatttttcctgctggttcttagagaattagctaagagagaaggtaataactgagttatgtttagttaccaattcatttcagctaagagacttatttccctatatttcagtcattaagtcaggatagtttgaggaaaatgctggggagaactaaagaaaattggtggttaatcccttaattattttccatgtcaattgtccctttcctaggtcattgctcaaaagagttaaggaaatcttttttttcactggatttcagaaccggaagtctttaattcaaaagttttttgtttgtttgtttgtttgtttttgagacaaggtctcactctgttgcccaggctagtgtgcagtggcacaatcttggcctcctgggttcaagtggttctcctgcctcagcctccccagtagttgggattataggcatctaccatcatgcttggctaatttttgtacttttagtagagatggggttccaccattttggccaggctggtctcaaactcctgacctcaagtgatccacctgccttagcctcccagagtgctggaattacaggtgtgagccaccacgccaggccaaaagtcttcttttctttacactctacaaatatatttcactttcaacaataagaatatttcttaataatttttataaattgaactattatagatgaaataggagagctttttaatttacaatcaaataaaatttagagctactatgaattcaaaggaggtcagtgaggaatccatttttcaagtacagaatcacttcctgagtcatctcacatcaccttcaactttattatgtattcaactattttgtattcaccgttggttgtgtcattcacatatgtgaatcttatttcctgatgtgtaatttcctttaagttaggatcataatacctaaatgcacaaaccaattatattttcattgaaaattttaacaatttaagttgtctttttgtaagttaacattttaagatatttttctcaagtgtattgcatctgtatacacaaaagtgtaattgttttcaaattattaagaagcaaagagttttttctagattggctgagaaataagagttacagaaggaatatcaaaaccacttggctatcatggtacaagcagacatcactgaaactttgagagaattgctttccatgtcactccactataattaatatgctgggaatgaaggaggctgatgtttgtagattacggtaaacagtggagggaagtgtatagttctgatagcgctcggagtaattcaaagaagtcaaataacaatgatattttgtgataatacattgcatttatagaatttttttcaaagatttcaaagaactttatatatgttatcccatttggtcccactaacattccatgaagataggtaatggctgctatcttccatcattcttttaaaataaattgaactttaggaagattaagtgaatttcctactctgggctatcagtgctaaacctcggtgtcctaatgcctatggtaggtgtttttttctgactgacatcacactgtcttctgctagagctgtcttgaagctatatattgtacctcggtgatctcatctaaccagatggctccaattatcactatatagataattctcagaaacaatacttctagacctgacttgtcccctgagtgccagacccatatatcctttctgtgcaatcttgtgcagccataagaaggaagtgcatttgtttattgatatggaaagatgtgctttatatactgattaaaacatgaaaattgcagaatattaaaaataataagagcttatttggattttttaaatgacacacacacacatatataaatgcataatgatatgatcaacacacacacatacacatacagacacacatgtatatatacataattatatattatatatacagataattatatatataattatattatatataatatattgataattatattatatatattacatattgataattatatatatatacgtgtgtgtgtatgtgtgtgtgtgtgttgatcatatcattatgcatttatctctgtcatagctctagctactgcattatcatatacaaatgtctgaaagaatatacactaaacagttaatattgcttggggaaaatgttcagtgagagtagaccccttacatattttattagtatatttctctatatttggtatgcatgtgccattgttgtgattaataaaaataaattatcgaaaaaaataaaaataaataaataaaatgtgaaaaaataataaaaatttttaaaagatcagcacagaacaaaccaatacctttaaaatgtaaaggattaccaaataatcaagatagtatggtactgtccatccacatgcaaaataatgaggttggacttttactttatataaaagttaactcaaaatggatcagacacctaagtataagagctaaaactataaaatgcttagaagaaaacaaggataaagctttgtgacctatgatttgacagtggatgcttatatatggcaccaaaagtacaagcaacaaaacaacaaatttataaattgtgcttcattaaaataaaaacttttgtgcttcaaaggtcactatcaagacagtgagaaaacaatccacagtatgagagaaattatttgcaagttgtctatctgataaggcacttgtatctagaatatatgaagagctcttacaattcagtaataaaatgacaacccagtttttaaaaggacaaagaattttgtattagacatttcttgaagaacatatcggcaataggcacaggaaaagatgctcaacatcattagtcatcagggaattgcaaattaaaaccacaatgagacaccacttcacacccactagaatggttataataataaaacagaaaatagcaagtgttggtgatagtgtagagaaagtggaacccctgcatacattgctcttggtaatgcaaaatggtaaagccaatgtgggagacagtctgtcatttcatcaaaacattaaacatagagttacttgacatgactgttcatagaagcattattcataatagctaaatggtagaaatagcccaaacatccctcaattgatgaatggtaaaccaaaagcaatgaaacattgttacatgctacatatggatgaactttgaaaagaactagtcacaaaagaccatgttatatgatttcatttatataaaatgtccagaactgataaatctactgagacataaagtggattagtgattgcttagagttggggtgtgtgtgtggcagaattgggggatgataactaaaggatatggggtttccttttggagtgataaaaatgttctaaaattgattgtggtgatgattgcacaactgtataaatatactaaaaaccattgcattttgcactttaaatgggtgaattttatagtatgtgaattatatctcaataaaactgttacaaaagaaacaacaatataatgactccactcagtgaaaattttatacagtggccagtgccgctggtccagggaccataccttaagaaccactgaactaaacgatcttcagtttaccctttttattcccccagactccaggttaaccagaggtcttcattcactgaccattttagttgagattttattataaattgctgttggatataattagttgccataggattctccttcattgatatactgtactttagggacttatagtcattgattgcacagtttaggagctttgctgtctattcttattccataggatgaggaagaggatctcaggactgaactcaaccttctgaggaagtactctttccacaaaaacattgtgtccttctatggagcatttttcaagctgagtccccctggtcagcggcaccaactttgggtatgtttttaattacactgttcttattctataagaataagttttacccaaggatgtatgttttcatgagttatcacttttgtgcatctacaggaaaacttagcacacaactgttaaggtagtatggtgtattaatctggtctcacaatgctattaggttggcgcaaaataatcgtggtttttgccattagacatacccgagactaggtaatttataaaggaaagagttttcattgactcacagttccacatggctgaggagacctcacaatcacggcagaaggcaaaggaggagcaaagtcacgtcttgcatggcggcaggcaagagagcatgttcagggaaattccccattataaaaccatcagatctcgtgaacttattcactgccatgagaacagcgtgggaaagaccggcccccatgattcagttacctcccacgacatgtgggaattatgggagctacaattcaagatatttgggtgtggacacagagccaaaccatatcatttcatcactggcccctcccaaatctcatctcctcaggtttcagaaccaatcatgccttcccagcagttccccaaagtcttaactcatttcagcattaactcaaaagtctgccgtacaaattctcatctgagacaaggcaagtcccttccatctatgaacctgtaaaatcaaaagcaagttagttaccgtagatacaatgtgggtataggcattgggtaaatatgcctgctccaaatgggagaaattggcccaaacgcaggggctacaagccccatgcaagtccaaaatccagcagagcagtcaaatcttaaagttccaaaatgatctcctttgactccatatctcacatccaggtcatgcagatgcaagaggtgggttcccatggtcttggccaactctgcctctgtggctttgcagcgtacagctccctcctggctgctttcacgggttgacattgagtgtctgtggcttttccaggcacatggtgcaggctgttggtggacctgccattcagggttctggaggacagtggccctcttctcacagctgcaccaggcagtgccccagtggtgactctgtgtgggagcttcaaccccgcatttcccttctacactgccctaacagaggttctccacgaggacctggccactgcagcaaacttcggcctggacattcaggagtttccatacatcttctgaaatctaggcagaggctcccaaacctcaagtcttgatttctgtgcatcagcaggctcaacaccatgtgtaagctgccaagacttggggcttgcaccctctgaaacaacagcccaagctgtaccttggccccttttagccacagctggagtggctgggacacagggcaacaagtccctaggctgcacacagcaagaggaccctgggcctggcccatgaaaccattttttttcctcctaggcctctgggcctgtgatggcaggggctgctgtgaagatctctgacatgctctggagacatttccccattgtcttggtgattaacgtttggctccttgttacttttgcaaatttctgcatttggcttgaatttctcctcagaaaacgggtttttcttttctattgcataatcaggctgcaaattttccaaacttttatgctctgcttcctcttgaaccctttgctacttagagatttcttccagaagataccctaaattatctctctcaagttcaaagttccacatatctctagggaaggggcaaaattccgccagtctctttgcttaaacataacaaaggtcaccttcgctccagttcccaacaaatttctcatctccatctgagactatctcagcctgaaccatattgtccgtatcattatcagcactttggtcaaggtcattcaacaagtttctaggaagttccaaactttcccacatcttcctgtccttctgagccctccaaactatttcaacctttggctgttacccagttccaaagttgcttccatattttcaggtatctttacagcagtgccccactctactgacactaatttattgtattagtctgttctcacgctgctcgtaaagacatacctgagccttaataatttataaaggaaatttataaaggaaagaggtttaattgacacagttccacatggttagggagggctcacaatcatggtggaaagcaaaggaggagcaaagtcatgtcctgcatggtggcaggcaagacagcatgtgcaagggcattcccctttataaaaccattaatctcaaatctcgtgacacttattcactatcactagaagagcacgggaaagacctgcccccatgattcaattacctcccaccaggtccctcccatgacatgtgggaattatgggagctacaattcaagatgagatttgggtgagaaacagccaaaccatatcatgtggcaaaatatactatgattcctggagatgacagtgataaaatatgggaaaataacttaagtgcctggcaaggggattactggtgggatgggggaggactcaaatgaatactggaaatagtcaacataaatattttcaaatattttatgtaattactatggttgctattacagaaattacccaatgaactaataaataatgactggataaggataaattctaattagcacttgacatgagcatatgggtgcattttaagtttttgcaaagtatatgcgcttatggataaacataactcctaagaaactcttttccaaatggtaagttgacttatccttttcttagtcattatgcctggtgtatcacaaattctagatcaataagatataaattgtagaggataaatggaacctatgctacctaagtcacagttaccagaatttttgctgccctccactgtggtaaaaatagttaaatcacaagaaaatcagttttggtcaaggatgtctttattaaaaattgaatatttagaatataaggtggggttagtatacacttgaatctctatacttgctgcatttccattccatgtccaagttagtagtattttttcaaaataatgactaaagcttttcagtatcttcaagtggcaataaagtattctattacattctaaataatggacttcagaaaataggacagtggacattatagaaaggttttcaacaaggggtggaattgaaacagtggttctctaaatttggcagccatcagaatctcccagagagcctgataaaacacctatttctgggcgtcactcacagaatttctgattcagtagatttgggggtgtgggtccaaaaaattatccttcctaataagttcatatgtgatgctgctgctactgctggactgatcaccacactttgagaaccaccaaatttatagaccttcagcttaactctgttttctctcagatgtccagttaacatgcatcctctattctctgacaattccagttgagattttagtaaatatggctgcatagtttagttactgaggaattttttttggcatataccatttgtcttttttatatattttcacttacaagtttttttttcctcttgatagtatagcaaagtgtgagaaattttgcagtctccttactggatatgtattagtactcagttcattcaggcattcaacatatatcaattgaaaactatctatttgtcaggtgttgtgctagatgctgaggataaaatggtaagctgaatagacatgctcctgacccagtggtgcttacaatctatttgcaaagaccagcgtcaatcaaataatcacacacataaatgtataattggtcagaagagaaatatcatggctgtctgtgggtgaataacaaaccttaattaagctgggaaatgagaaaaacttccttgaggaataaaagcttgaactgagatctgaaggatgaataaacatttaatgcataaattatttgtgaagataagaattttcatgggacacttcacaaattttggcctatataaatcagaaaaacaaataggaagtaagtaaatagcttaataatgaccattaataaagaagtgtacgtaccaggcaccatgcttacaaagttaggaaaattactgagaatgtcttacattccttttatagttgagctcttctgactcacataatataagcaagatcttccagggtttatgttagttgaatggctttaattctggtttgtcatggttgaaaatgaggagttaccacagtgtacatgttgtgcccattcaatatagtcaatgcttaattctccacgtgaaaatcaactttttgtggcttatctgttttcgttttgtttggctgtctcttcttctttttggtgaaagtgtactcaggtgaaagacatgcaataatatcaatggtgaataaccgtaaattaggggagtagttttctgaaaagaagatcttaatattccacaggaagtaaggtagactttttgaatagtcatgattttgagtttatccttttgcttccattcatctatggtgataattaatttgcacaaagttaaaaaaagacattttgctcttttgataaagtatttttgaagtgggcagtaatacataaacctgtactcaaagaaaatattgctaggataattataatagttatatgctcttgtacatcactctttagttaactcatattacctggatgaaaatttactagttgggccctcaatttatatgtgtcaaaaataaactttctgagaaactgagtttattaatacaataaaatctgaatgaaatattattgaagatattagttttaaaataggttttccttagtagcaatcccatttggatgaaattatcccacaggaatgcaattgacaaattccaccttggagttgtagcttgccagtatcttgaagaaaatagtttggaatttgaaaataaaaacaaaacaacaaaaaccaaacctagccttaatgttgaaatgtaaactcttttgagaccctccatattttgcttcttcacccctgattaaactgtttccttgaccatcctttccttcccattccagtcgtcacttaggtttgttccttgcacaaacttctttctaaaagcatgtgtttatttagttttccataaatggaatgttcttccttttaagcatatacaaacaccacctatccttcaagacatagctcaaaccccaacttccagttaaatatctctggtgaaatacctggcttctctgcctccacaaatctttggttttaatccaactctctctaatttcgctagcctttggagtcttccatcagacaattgaggcagtacttgcagtgccttaatctctaaacattacatatagatacaagccatatggactaaaactctccagatattttcagaaaattggacactaattttttatactttgctggctttcctgcagatggtgatggagttatgtgcagcaggttcggtcactgatgtagtgagaatgaccagtaatcagagtttaaaagaagattggattgcttatatctgccgagaaatccttcaggtgagtcttcatacagtcattctcttctgatcttttaagaacctgggagtaatatatacaatgcaccttatacctgctcacatcagatagtttaggtattccaaacataacctgtgcatcaggatatctgaaaaggccaaaaagcttttgagaaagccaatttgcagctgacgcctttaaataagctgggtaacaaactcctttgaaatcatggcctttaatacctctgtcggattaagactactgtgttcagtggatcatggaaatgaccacttggattatttattatgttgttattattttagagttctttaaacaaaaacatagcacaagcatcatagattaagatgaagatgagtcagaagaagtcagtattttatggaatggcctcaaaccaactgtagccttttggcagacaaacattttctttgattactgccccctttttaaatttctttattttccacacccagttggatgagagcaacaatcttcttgatgtaccaaattccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacattgcataccacatcatgggttagccaggtcatgggtaaattttagtggtgaatgggctagagccaaagtgttaagccaacacagattacaaatgctgtaaaatgaatttccacattcccctaaattctcagcctacaaagctgactagaaaatattttggactaaacaaatggttgggtaagaaatagagcaaaactatagctgagctgtgatattcaagatgtccagatctttactcttatggctagttggaaatacggaggctaaaaaggaaggtaaagtggcccaatgtatacaaacattacttttggtgctcttttttttcgtgggtgtcctgatttattttcctttccttatagccaaaagtcatatttctgggaacgggttgtagtgattccagcctaaagaaagaattgtgtctgaaacatcaaaattaagctgtttctcttatcaaaagtttttccaaaaatactaagaactgtaccagaaagaaagaaagaaagaaagaaagaaagaaatatatactgatgtggctttttaaaaaatatatacagggcttagctcaccttcacgcacaccgagtaattcaccgggacatcaaaggtcagaatgtgctgctgactcataatgctgaagtaaaactgggtaagtttattcttatagtattttaagtccaaaacatcttaatggagaaagctcctttaagataactatgctttctatcatgtccctgccaatatcctctacttatttgagctgggttttccctgcctgcaaaaccagtcaaaatttgaaaatttgtttgggagaggaggcggggcaaaagaaagaggatgcacatacctgcttctttgaaatcatgtagataaaacaacttttgaattataatggggatttactttttggccatcgctttaccctctattagaaatagctattatatttatttcaacaattgaattgagtatttaccatgtgcaaatttcgatgccaagggaagggatttaaaaaaataaaaaaattatttcacatgacagagtcatattttctcaagaatatcaaataacttttaaattatgtaaggatgaattgcttctttggattttttcagatatgtaaagaaatgatattgatcagaatcgatgctccaataatatgcaagtcaagttcagaattataaatcaaaagactggaagtacctagctttctatgccagaattcagagttatataatttacttgaaaataaccacacatactttctgattttcttgtccttaagctcatagggaacaatatattgtaccctttaatgtgtaaaataaatatcaatagtttttagaataataccataaaaatcatgtcagtacattgtagtggcagataatcccatggatatagaggataagtcacttgcattatttttcaacagtttgtaaacatgtgtctgaacatgaccttaagatatttcccattttcttgctaaatagatagaacaagagtagagattttgttcattcattaggaacatttttcactgaacatttgtggaagaagcatgaggtagtaattgtttattcttggaataagtgaaagtagtttcaagagagtgtattatttcttttgtgtctgtctaaaagctataaagctagaaacacaattttaaaatacataaggagaggccaggtgcagtagctcatacttataatcccatcattttaggaggtcaaggcatgaggatcacttgagaccaggagttcaagaggagtctgggcaacatagcaagaccctatctctacaaaaaaaaaatgtttaattagctgggcatggtggtgcgcacctgtggtcccagctactcgagaggctgaggcaggaggatcacttgagcctaggatgttgaggttgcagtaaactatgattgtgccactgcactctagcctgggtggcagagagataccttgtctctaaacaataaatgaataaacaatgaaaatgtaaaaaatacatgaagggcatacatacttcacatttaaatacgcaggatagatagttaatcacaaggctaaacactgtgttcgcatatagagcaacactgtcatatacttgtgtcaagttgctggtcaacgcaaacatttacagcacaaaagagaaattgtatgtaaatgaaaaaccactgaaatatctgtcacaatgtccatgcactaaagttcatgtaccttcctctggaggagagaccttctactgctggattagagtttaatcagatttactttacatgtagtccctgtacagtttgttctagatttctcagattatcattattttgaagtaacacattataaaatttaatcacacatattttgcacttaattcttttacaatttgttttaaatttttaagattatagttgtttttaagcaacatagtataagaagaaagtttcagaaagcaaacctaatgacagccaaaggaactgatagaagggaaagagatggaaaaatgattatattgcagttgcaattgctcgataatcttcatattccagcctgtaaggtcatgaaagaaaactttaaattatgccattgttgaggtttcatctcgtcttggctttcatttctctttctcttgctcttttttcttttcttctattaatcagtcttctagtcttttctcctttcattttctcctctggatatgtgccatatagcaacttatggccttcctaggtaattcttggcccctaatgccagttcacagggatagtgagaatgctgggcaattatttaacctgtttctttttaaaaatctagataaaaacatggcacaacacccaatggtgatcttcacaaatattgtggacatttttttgttgttgtcgttcttgttagatcctctaaaactgccttaaactcttaggtttttctttttcctttttcttctcttcccctaaattcctgaagcttctttttagtcagttttgttcgccatcctctggattcctggaaaccattctaaattagaaaatctacttcatttttcatccctgttttattttttctggaataaataaccccagcctacttcagccttttttctgtttctgaggataccataccaaatattttcttataatgtatcccacagatgaatagaagactgaacttttataatctaagctaagatgtagataccacagtaaatacctgcatctgattcaaaaggtctatgtaggaatttaaactaaattctagcagaaaaactcatttttatttatcagtgtgatagagccttctcatatcatgtgtgaggcttcctgatcaactgctaataagttttagatttctttgttcttgcttatagttctggtcttcctccagcttggttcccaggtccaaacactacatatgttatcatttcggaggttcagagtgtcccgacagaacattatttttaatattcatggtaaacaatcagccaaacctactgtagatttataatagcactgctgagtctcattccaaaataaatagcaggaaaagcttatttcccagtattcctggagtagacttcatggtaaagtttgctaggctggaatgaaaatctgttatccattgtggcttttgtatcagctttccaagttaaagcaataacttattaagcttttttctcctgattgattattttgacatataatgatttttggcagttgattttggagtgagtgcccaggtgagcagaactaatggaagaaggaatagtttcattgggacaccatactggatggcacctgaggtgattgactgtgatgaggacccaagacgctcctatgattacagagtgagtgtgagaattcagccagtggaaattacaatttggaaaggatttttgattaacatttatttttaatgataaaacaaaaaataaaaagcaggcagctccacattttacattaaatgctagtaggaaatacaagcctctatttcggtaagtggtttgattatattcataaaataatattttctgagaatgtggacaaagtatataccactgagagttacctgcatttgaggcagaatgtgtggtttatgttgcttgcaacctattggtaaaaatattatataatgtggatttatatgtatataaaaatttaacttccaggagcaaagggcattgtaaacttaaaaatgaataaatgtaaagccaattattaacccccacagtaacttagctccagaaaagacaaaaaataatttgattactcagggtaatggagaaaatccttggcatgtttcacttccaaaaccacagaaaatcagtgtaatagacaaattaagtaacaattcatgctatttattaaaatttccactgaaactgcaatttgaacaatatacatatatccatgtacacatttcaaaaggttgatgtggaaagaaaactctgcatttgctatagactggaaaaacctcactcactctccacataagtccaaacaattaattgtggtctccctgagtggaacctaggactcaaaacttgaagttgattaagattcatctcttttccctttccttaagtgccctttacatgatctgcaaaataattatttactgagagtctattatgttcggtgctgttaggagctacgaagactatggaagcatgttcttcaagtggctttttataaataatgctttataattgtatactttttgcagtcttccaaggactttcacctgtattcgttatttatttttagtttttagcaccatgtaactgaaagaagtcttaagcatagactatcacaactcaagctaagaaatctatcaactagggttctaaaaatccagttaacctccgaggccgcagatcacctgaggtcaggagttcgagaccaacctggccaacatggcgaaatgctgtctctactaaaaatacaaaaaattagccaggcgtggtggcaggcacctataatcctagctactcgggaggctgaggcaagagaatcgcttgaacccaggaggcagaggttgcagtgagccgagattacaccatcgcactccagcctgggcgacagagtgagactctgtctcaaggaagaaaaaaaaagagaattcagtaaacctgtttaggagtcatttagccagccgttgtatctctagccctgtgccctttccacactctgaagaaaaaaagtactaaacagttggtagtgaagagaattttctagagtctttttctagtcttagtttagtatattccaggaactgctgaagtacacacacacacacacacacacacacacacacacacacacacatatcagtcctatgtaagtgtatgctattgttatcaccattttacttagagtggaattaaggcacagggagttaaaacatttgcccaagatgatacaactggtgggtctatgtaataaaatgtctttatggcaagtttcttttggtatttcaggtaaaacgataatatcaatgcatccaagatgaactttccttgagcttaactccattccctatcaacctgttgtgtagtgaggtactggctggtcagtagctcagattatgtcttcctataatgtcactctataataaagcttcattatgggaaacccataaaagagctctggcattgacatccacacccccagctaaacattgttttgagattctaaatactaccaatttcctatttttaagtgacttttttgtcatctttgtctttgcagagtgatgtgtggtctgtgggaattactgccattgaaatggctgaaggagcccctcgtgagtaaaaaatgtttgatatttgttaaagattagggaaatgtactgtacaaatcatacaaatctctctctgtcgaagaagatgagattgccacttgtaccactcagctttcactggccacacaggtgtcatactatgtgccaaactacgaatggtggccttttcagtgattaccaaatgctttcttcagaatagctagatgtgggtatataaatcagcttgtacttttctttcttataatatcttattttacattgactgagtgttgtttccatttagtctcagtagtatttggtcctgacagtcctgagcaaccagaataaggattctggttggcgttccagtctatatttcctggtggaatatttagattccagaacatttacagtcacacagtgctactgcctcaggctgtgatagttgagaaaattctccagcatttcattgaaattgagctaatgtcaagaagtaagcctgttttttttttcctctggagtcaattcaacttacctttgtgccctctttactcctttcagctacctcagcgcccatttcatcttcttttctctacctccccatcatttaaatgacctgttagcatcctgttctctcaaggcactgctttctgataggaaagtaaaaatggaatgtaaactgggtataagtgattgataaccatctaatgtgtgactccagagcatggcatatttgctgtccttagtacctaaaatccaaaagtataaatgacaatgcatctttggtattgttggatgagaagtgtaaagtaatgccttctggggtatggggagggttgctttgctttcccctctccaaagcagatcctataggttcccatgttcttgtatgctctatctgcaaaatgtccacccatcaagttttatgagcttgaactatcttagcattttgtttcaaggccaatgagaggaatttcaagaaatagaaataatggtaacataattgttgaaaattcctggtatcccttggaatattaaagaggggctgggataaagctaggacacctgtggagatcatgttgcttcttgcctgtattataatgcccccaaatcagcaaagtacctaagttgggtgaataaaaaattaataatggaaaatgttaaacaataagaagattacatacgacacatatataaaattgaaattatactgaggggatgtggactattcctcatcatctcctgattatttctgttttggaaacatacttagattatgttaaattgagcagcagcaactaatatttcatattagtattgatgcatggatttggttaggatacatgcctgcattgagtagtatcttttttccattgtttctgaatgctcctcaccatgcctttccgggaaaccaactttctatgttttccagtttgtacttcctgggtcaccttcgtttgtttcactttttttttttattccaaaatattaagttacgggaaaaagtattgctgagcaaactcacaggagtgcagagaaggagttttgcacagattacacaaatggcaagcttcttacaaaagataagtgaaggccaggagatttggaactcacaaagggagaaaatagggctggcctgcctgggtcagtaattggagtaatacaactttggtcaagagcagccctaaatagcctccctactaaaacatttctcttttaccggtgtcctttgttgcctggaatattaattttgtatggaaataattgtcatcagtttaactgcagaaatcctccaggttatgataattattatctcataagggatggccttccaaagtgacaattatctgataatatcctctgagttccagataacaaaattctcttcctttggtcttcctttggtgagtcttttccagagaagtaaagagagagaaagaataacttctccttgataggatgccatggggcataggttcccaaaccctgggccacacagcaggaggtgagcggcgagcaagtgagcaagcattaccacctgagctctgactcctgtcagatcagcaacggcattagattcttctaggagtgggaaccctattgtgaactaagcatgcaagggatctaggtggtatatttcttatgagaatccaactcatgcctgctgttctgagatggaacagtttcatccccaaaccaaccccctacccctaggtccatggaaaaattgtcttccacgaaactagtccctggtgccaaaaagtttggggaccactgttgtagtggctctagaaagagagaactggacacttgtaaaccaggaaccccttcagtccctagtttctgggtaggaattcaaacaatacggggacctttataccaaggccagaacatttataataatcatccaaacatcagagtatcataggttaattttgaatagatgtggtttttagtctctatcttttatagaaaagataatctgtgcctggaggagaagcgggataggatcaatagttaagcctgacacccctttcttggcaaagctgtacactagtcaacttgccttaacctggaccatattttcccctatttttgcattctccttgatattgtagatcattttaaatattctcaatgatgcttctttatagtcctacttctatcccttgtagtgtcactctctcataccccatgtctgtctttacctgagtgcattgtggctcaaatctaccccatcccatcaagaggcttattccttcaatattcagaagattccctcagatctcaacatgtgttaagaataaatcacattatttaacctaattcagactaagcccaatttaatatgtgtccaacccttcaagagataatgtgatttttaagggaggcttgctgtttcaaaggaatgagcctctaatgatgaacatttaggtagtgttatgagatataggttggagggggcagttactgacattcctgaaattagactatataggaaaccataaacagctactgttgacatagctcttgtacccaccctatgctccattcctttgtgaacttttcctttccgttaaagaaaacttacctagtctgtgtcctagctcttgacccctgaagatgttgtcagtggactaactgttgcccagatgttaataaatgacaactgcttaatattgtaccaactcccttacaataagtttaaaggacagaaactggagactgattggacatagtaaaagaataaaaagggttaaatatgatcctgatactttgtacttggagctaattctgccttcagttataaaaatgcatcttctattaatttatacccatgtaattgaaaacaaagcttggcctttaaacaattgcctttgtatagccctaataaaatcactctgtggagtttttgtctactactatgaaaggccagtttgtcactttaggtatttctgaggatgcattttgggagagaaaggatggctctatcaagagtcattaatatcaaattatccttacaagaatgacacacttgtaatgttagatgaaattgacactgtggttctccattggggattttttgcactgccaactttctttaatcaaaacacaagaggaaataagtgagacatatttaaacacttatagaaaaaaccaaatttcccaaaccaatgaggtaattaatttatatagcacatattggaataggtttttatttttatgcctgtgtgtatgaaagagagaatgaatgtccagtaatttggcacagtctcaaagtgccatagagttaacatctttgttataatatcaatagctgatatttatttagcatctactacatgtcagatacttttgaggggattttaaaaattatttaaaaaatttttgtgcatacataatagatgtatatatttatgaggtaaatacacttttacttgtaagtttctaattaatcctcacaacaattctttgaagggattcctcctgctacatttcctgtttttcaggtgaagaaaccaagatacagataggctaggtaatttgcccagtcacaaaggtagagctaggtttgaacgcagatgatcttactctagggggtgtattcttaacagttgcactatacctattttttttttctagaactctcagcttccaaaacagatgcttctaagctttctagactactaaatcattgttctttaaatattattgtactaagctagtagtctggttgaatttttcagtctgtaattacatattccaattttataactaaatacctgcaatacaaaaacatagaagtgtgcttgtttcactttcagttaacttttctagatataaattatcaactatacatttcaaatattttgtctagtttattattaatttatcctacttggtgatagtgaaacttgagaatcttatatattgcaacattgcattaaaacgagcttttctttttcttttgaaatacattcttttgtatctatttgtcccttagtgtctactcaacataatatgtgaaagatcactgagaatcccctctggaataaggagtgtgttctttagttacccttctcattctttctaaatttatctatttccctttgcagctctgtgtaaccttcaacccttggaagctctcttcgttattttgcgggaatctgctcccacagtcaaatccagcggatggtaaagatgaatgtcttaatctcctaattacattgacttgacatttttatgttagcaaagaagttttaattcatttggtcagtcctgctgcaccatcctggttggacaatatttcctaaagtctaatatcttaactgggaggtctaaatgaccagttttcattaagaggtagctagccaactataaataagtaatatcctctatagtattttctgatgatattactgtactgccattaatgggcatgttcagttgtttccccagtaatgggatgaactgatggcaactatttgtgaagtttcttgtgttgcttatataggcagtcagttatatgcagccctgttgattagtacattaaaccaaacacacacagacctagagcagaagacttgttttcccagggcacttacatgccagctaaacttgggaatccttctctctgaagcttgttgatcttgtacctgaaactcttgcttattattagtttttattgctttccctggtagaagtggtgactgtgatttgattgttaacattctgcattggaattcaatttaaccctttccatggattcagtttttatggccacatctgttttcatgggtcattttacaagattagttagtcctggtgcttttaacatcctatttttggatcattatattcattcctctgtagttaaaactgcatatagtcaaatgaaaaatacagagtatgactgctgtgggccgatcaatctagtcttgcagactacatatatcacattaaccatttaatcatcatatctgcacttgagtttttaccaggtacatacagttaactcattgaaacttctactgtaatttagatggaatatgctattgactcttgcttctttttctgaggtctaaatggcctcactttataacgtatgttgccaaactgcaggatatttggcaattgagaagacaataatacctaaaggcaactctctccaaatatgattttcagagaggcatgtgggtggtggtgggaagaggtctgacaggactgagaacacttttttttcctctctttgactcattttttaggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggtagaatctgttaagttttattttactgaaatgaatattcagagtttattcatgtattgtttccaggaaaaagtaatatttgtttaagacttagattgaaaataaaacttctgaggcctttgatatttagttttgccaataatatgccatgtgctcttatttaattttctcttgcgtgtgtgtgtgtgtgtgtgtgtgtgtgtgtgtgtgtgtgtgtgtatagttactaattcttgcagttacacctggcaaatgttcatatttatgaagaccttgaaagcatccaataaagttttgtgatatgccaattttaagtaactaactaaataaaataaataaaagataaaaggtaacaaaatgtatatcttgcttttttttcagctggtattttgactctacaagagataaatggatttgtaattaaccatttattcactgctaattttgaagtagtatttgtgcaccatacaaagcttgttttatgtactaaactccaaatataaaatataattaaaggaactgatttatacaaataaacataaacttctgtctattaataaaagtgaacttctattaaaaatggcaggatttgcagtgagccaagatcatgccactgcactccagcccgggtgacagaacaagacgctgcctcaaaaaaataaaaataaaagtaccaggatggattttcaccaagtccagaagaagcccctgggaagtcctaactttatatattatattacatattccacatttgattttgcggaccataggcagagttgagagtaacaatggaatgtaaaagggaaaacttgaaaaagcaggcatcctcagatcagctgtgggattgattgtagtggggcttgttgtatctatacatgtatcatgttttgaggcaaggagcagcaagaattaatttatttacctatggtaatgaagttattcagccaactttacagaggccagccagtttcaaatgggttcaggaaaaccacacatctatatggtaatttgctaatttccagaattgcaaaatttccaaaatgttacctgtaggaaaagttccatttatatggaagttacactaaagatataaatatagttgccctgaacattttaatataggaaattcaaaataaaactcttgtttgtaatcttctatatttcagtagtcacagtacagctgatgataggaaagaagctgaatgttttcaatgtgtttagtgtaaaacacagaattaagaatttgccttctcattgaaaagaccaaatatcaacctcaagccataaagtccttacatctagagcccacagctgtaagccatgctcaccactatttagagtttctcttgtctcattctccctttgtcccattctctcttcttcctctttagaattgcagaaatcaagttgctaaattttctctgttcagagaaattaatctgcatgcaatagctatattgtgctgcaaaagtgggcctagaaactagaatatggtctacatcacaaaccaagtacttttgaagggctaccttcttgcccttgtaattcactccacatcctaagaagcagagggaacaaggtgattaagtggataacatgcttatctgctgactgtttatgcattatgtttttctcttttgtaaaaaaaggaatacctttgatctttgaaagagaagaagctattaaggaacagtacaccgtgagaagattcaggtgcgttccacaaattgcatatataatttgatgatagcaattcacataaggccgttgattccatactgttgcctttggttcagaaagacttaattctttctgatacaacaaataacaaatctctgtttttaagagatattgagtgaaaatgtgagaattctttattactacccaaagactccttaatatctggcaagtgaagatcaagtagatatcatatttcattaataattgaatacattagtaatacaaatgttacctgcagaatatttcagacatcaagggaatgatttcagaaaggtttactgaaggtatcttcattgcagaaaatgtccatcttttaaagtaaaaacaatgcccctgaatggctccattccactaaaaattctaattgtatgccaatcatttgtgtgtttattttagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagtaagaatttttgatatttttactctgagtcaaaaatgaagagaaaatgtgatagctcatgcggatgttttttctcagtaaaaccaaatgaaataaatattccttgtgttctacagaagatatactaaataatttgtacttcaaataaattttcatgaaatttctagataattgtaactaaatatgataaaaatatttttcagtatctctactgaaatatagctttaattattagttttctgtctattattctttaaccaataaagtgtcaacgaatgcacattaaaaattactattttggatctttaaaaattactttcatagcttaaaatttcaaagataactcatcaaaaataagcacaaaacaaaatttgcttttgttactctaacctttaagttagtttattctttcttccaatagaatgccaaactatactatttgagtgaattacactcatttttgtactacaggatgtttaaatcaaggttaaaatgagaaggcaaagcagtttccaaaatatttggtatatggttaccatatttatgacttgtttcactaatttgctgcccgttttacataattaatcaattatgtggcctcacagaacgtgaaacaatttacaaattattctccgtgttagaagaccaacaggttcgtatgcccactgcatagtaacagaccaattacacatgcatcaagaatgcagcagaagagtttaatgatcagcagggcatggagtgaggaggtggggaggagaccctcaaatccatctcctggaggagttctgggatggggtttttaaggggattgtagagggtgaggtgctggataattggagttgttgattggtcagggtaaggttgatggtccttgaaatcatcaggatgtggaaactgcattttttgatgagtcagcctcttgtggggtccttcagaccagttggcgtcagtggggtccttcagaccagttgattgacaatagtttcactggtatgcaagacctgaagaaatatctcaaaggaaaaacaacatttcataatgttcaagttgttatctacagagcagttaaggggaatgatgatgttgcaacaaggtctacgtgagtctaggaaaataggcaacaaacatctattgaggaaggaggtcagagagcaagctgacctaaagattaatgctaaacgtgctgcaagcttggtatatttttgtttcttcccctctcttcttctgtgattaattttataagttaataagggtggtttcatctgtacccttttgaaatgtggaatacagtgtgttaaactccattttatctaagaacagtcactaaaacgtaattgtttcaaaaatcctttaataaaaagtgaatataattttactggagttattgaatttaatctggtggattctaaactgataatgaagaattatgggcttgataacaaattaatgaggttagataaggttaggggagcagttgttttctaatactccccacatccatttgtgtaaaaggaatcattgtgatgatcctaacttatacccttttatccacatctatttacccaataataatcattgtaataattacaaatgaattttatctgagtatctagataaggaattctttgagtttgtgcacattgagccaattaaacaaatgctaatttgttgacatgtttaacatgagaaaaggtaggagcagcaagagaagcaaggcccaaaagggaaaatggatgtctagttctcagagaaaaagggaactataaggagcaagaaactagatggagaaaagggaggtttaagtctagaatggtgacatttggcaaaaactagctcatctaaaatgctaatgattattctcgatgaaccctagtaatcaattagatctaatgggttttgcatttatgaataagacttttattgatctctgaaagattcagtgataccagcatggcacacacttattgtcatttattgttttaaacatatatgtggaaagccattctaaaatttttaaaagtcaataaataatagttaccaatctcatgactctaggatattgtacaagcatttatatctttatatgtggtcgttgaagaaaatataaaggaaaagaaaattattgataatatagtcaaagtcacagatcttcatgatacctgaaattttattagagttgagagacataggtgggtgctttaagtcaccagcaggaaacaaaaaatgcatttttattaatctttcagttgaagagataatattgattggattaaaggggaaaacagtttcctaaagtcctagatctcaattagggagaaatatttgcaccactgtattacagatcttccattgctcaggaagaccaaactttggttataatagcttgctaaatgtgacagttagtttggtgttatgagtcaatcaagttttaggccagagattcttaacctggaccctgtagatgaacttcaggaggtcagcaatccaccagaaaatatatgtaataggtatgtctatatgcaattttctgtggacagtctatagcatttctcagattctgaaagggatccagaaccaaacactattagaaactactggtttaaatcatttttaatatttggatattattcttttaaattgtgtattattttaaattatatattatataatacatataaacaattcagcattaagatgatgaagttgttcctatcacttgcattttaacaacaattaaaacaattactttcctttttgtttcaaaggacaaagaagatgaatcatcagacaatgatgaagtatttcattcgattcaggctgaagtccagatagagccattgaagccatacatttcaaatcctaaaaaaattgaggtaaatttttcaatatgagttgttgtgacattagtaagaacccagaacagtggttcttaaactttttggtctcagtgtccctttatactcttaaacattgaggacctcaaaaagctttcattttttacatgggttgtatcatttgatatttaatttattaaaagttaaaactgaaaaacatttaaaatattagttcatttaaaaggaatgaaactattacatgttaacataagaaacacatttttaatgaaaaaactgtattttcccaaaacaaaattttagagagattgacattgttttacttttttgtaagtctcttaaatctatcttgcttaatgaaaaacagctggattctcacatctgcttctgcattcaatctgttgccatgtgttgttttggttgaagtatacgaataaaagctggcttctcacatataggtagtgggaaagagtcaattttcatagattgcttagataattgagtaaattattgaataatgtaccaaaactagagaagtggaatctaaaaccatatcaatgaaatgttgtatattcagttaataataaaactcattgatctatcttatgctatgaatagatgttttgcttatgcatgatttttaacttcatgcattgatcagttggaaaatactggttcactttgtatatagatcttcccagacatttacatgtttcattatacaatatcaaaaaacagcatttgttaatgttaccatcaagttcatcataaaagttactgagtgttgttaaattgtcaagtgcttggtgggagatatgtttgaaaattctaattttcctttgcaagctcaaattttatcattgctaaattgtggcatcattttttccccttaaattgacaggtttactttattcattaaaaataaaatgtctaccaaatacccagagtttaaataatcatagtttgtcagtctttctttaagcaaaaatattgtacattaaaaattctggcagtttcgttttgtaacacaaacacaaatatttttccttgattagctctggtctggaatgcagtttgtgacagggtctgggacatttaatctatgttttgttttgttttgttttacaattataagaataattaagttagtcctagtgtccattttgacttctgttttcatgagtatattaatagtatcctatttagaacatatattggtgaggccggagttgtaggttttcttgtctagaaaaggtagcatcatcatcatagccagtattcctaatagccagccatctaaaacaatctttttgtagattgttttgaacaatcaagtagattaggtgagtgtgtgaagaactcaaactcttgccttattgatggtgggtcaggagcctcattgttgctcctaatcagcacaagatgttacacaggagtctactatgaagtcttttatggacaactctcatttttaagtacaattcccctaatactaacagtcctctgaagttaataacaaagagtattgttttataagtactaaccactggcagaaggtacataagccagactgtattatataattagaagaggcaatatgtctttttctttgccttattaaatgactttactcaaactcacaggtaataattattaccttaaacctgacactttaagcaggaaatgtaatgagctgtgtctgatttgaaatacatcattatcttagtatatgctattcttactaatcattttcttctccccagttttgaaattaaatacagccaatttatattaggaattatattttttatttttggccgttacctattttgagtaatttttgcctccagtagtgacaataaacttcctaagatcagcttcataagccaaaagtccccgactgggtcatatgataccaattatatgaaatgaaagtggaaaaaaataggcagatacttaccctcacctacttgtctctcggagtgtagagagagccttgataagccacttcataaagaaaaaatagtttactaaggctactctagtttctagaaagtatagaatgagtttatcagcatgcatatgctagattaaaaaagtaacactcttaaatttcctttttaaagaatctagtatgactgccttattgcatgtcagaatgacctatgttttgggcagctaaaacttctttgagtagaaacctggtgatacaagtcttagtgaggcaaggcaacattccctggccctgtctaccaatgttggcagaaagtaaaattcccccattggtggaagctggcttattatatgcaccctttcttgagtatttggctatattcaatgattgtatgattagtaaaatgcaaattaatctatttagagttgaaacagtacttggaacactaattatgatagtacagtcaaattgtaaagcagaaaaacatactttcttactttcttaaagatgggacacttttgactagagagattttaatgaaatgtatgtatgtgtgtgtgacaacttttgaaaatctagggttagcttaaaaggatgagtgtataagaattagaacttaaattctgagtaagaagtttaaacttgatataaaaagcaatgtgataacatggaaagaacattaaattagaagttgggagacctgcattctgattttagacgttcctttcacttgacataaaattcttagaaaagtcattttccctctttaggctacagattcctcaacaataaattaagattttgattatatgagctccagaatctgttcctatactaaagatcaaatataccatcagaaattatggttaagcaagtctaatgttgtaagtcattatgaaatagaatctgtttattaaaatcatattttataagttagattttaggaaaatatatatgaagacaggcattttcccacaaattaagagctcagtacaatttatgatcaagaattctactgaagtattgcattgtgtctttaaggttcaagagagatctccttctgtgcctaacaaccaggatcatgcacatcatgtcaagttctcttcaaggtatgtgtctttgatttctatattaaaattattcataattatcaaatggaaaattaaaaattatttcattgataatacactttgtgaagtcaactaaaatatccgtgacaacatcatcaccattgactttattggcccacattgaaaaccttaactgcaatgatccattacctatatctttcatatttggtcatactgcagtctctgtgatatttagtttgctaaatagatggcaaggttcacaattttaaaaagaaacaataataacaaatactttgacagtattcaattagtagtcgatgataaaaagacatgaaatttcaagtgaattttcacacatgtgctgcatgataaaacacacacaccaattgtctttaacttcagaagctaatgccacagaatgggtaagcctaaaaatgtcctatagtcaaaatcaaatctaaaactcaatattatataaataaaatatcatatataatattgataccagtcactgtattttttaatctttgtaatattggtgatcttcaataattttcaaagatcacgttccatatgtcagatattgtgtgcattctgttatatttgaaaactaaattttaaggtagatttttttaagaaaatctcaccccctccagccccaactcacaatagagagaacttagcctatattgattcatttagtcagtaaatatttattgaacactcactatattcaagatattggacagtatggccagatggcgtacagttaatgttatgtagtatatattttcttgcttcattactttaaaaaacccatacaattatgtcttcagatttaactggagtgcagaaatcttgaaaaattgtaaagcaagactgcgaactttctttttctctgcactcaatgaatggattgtcatggtcgaactgacctcaaaggaaagaaaccagtttagttttgagtagttggttttggtatcatggaacatgactttaataaaatccaatatataaaatccatacttggtgttaaactcagagtaattgttcactttacaaaaggattttgaatttatgaataacaaatacgttgcctttaaatatagttaaatttaaaaagttaacttaaatgaaactcaaatctttccggaaatttggggccatggaaaaaagtttgtctattccagacctaaatcaataaccaaagtccttcccatatagaaataccaaaataactgtaaaatttagcagcattagtccaaagaaactctctaaatattctttaaatttgaatagtaagaacgaaagtgctctatttttctgtcagtgtagctatctaaatccggaatgggacgttaaaaacattaatttcaagcatttaaaatctggataataacaatagaatatatgacataacagtaacttgtttattatgttaaaatactcacatacactataaggttatgtttattgctgtgttactcaggtaaaatattgtctgaatgttagctttaaaagcttatagaaatttttagaaattaatatatatataaaggaaacatatactctatgaaaacatatttttcttattttggaaatcgttactctattctagacaaaatagcaagtttgggggagaatggaaactggaaattattactcaagttatacttctttttcagtttgatatgtacccatatatttaaacaaaactttgtgttggactttatgttgagttgtacattccctttatgaatgttaggacatggcacatgcttttctgtcttttcattagcgttcctcagcggtctcttttggaacaagctcagaagcccattgacatcagacaaaggagttcgcaaaatcgtcaaaattggctggcagcatcaggtgattcaaagcacaaaattttagcaggcaaaacacagagctactgtttaacaatttatatttcagaagtcaagaaagaagaatttcaagaaggaatgaatcaaaagtgtcagggagcccaagtaggattaggacctgaaggccattgtatttggcaattgggtggtcagtggtggcctttgagaaatggaaaataatttttctgaattttcttctttttgttgggtagtagttaggaatgtgtctaagaaggcggggggagtcagctttattaggtttctataccacgtaagaaaagtatggtaaagaaacttgagagagacctctccagcaggctaaaatttataggtagcaattagaatattgtatggaggagttgtgagtgtgtgtttcatttatcagttggttacttcacctctccaaaataggacaatatctgataaatatccctaaatgttacagagtgatggttttactcaaaatacatgaacaattaatctatcaaatcatagaaaataacttcaaaagttgtgatgtgaatttcaaaaaagtattttaagatgtgcttttgagagagtttaaatgaattatagatttatgaaatattaggataaacaaagccaaaagttgtgccatggatcatgcaatctggcattatccagttttaagcaatccaggtaagttaagcaagggaaaaatggctgattgagttgctgatatgtaaaaatatagtatactgattttattaaaatgttaataataaaaatgatacagatgtacttcactttttgaaaagtgaatatttgaagatcaaaacttaaaacacattattcttcttaagtgactcagattatggcagagttcttttaaatagcactgtctcctcatacacaaatactatgttgtgaaaattagataagcctgagtgaaaagcaaatttttaaaaattttttcccagagtcttttctttctggcttgactatggctaattttgctaatacagggcaaacaactaaaaatttaaggtttattcatgtggcatctttgaaataaggaaattctggattagatcccaaagcagtcatagcattgatagaagggagaaggcatctgtgcagataatagctaaatgtcttttcagctccaaatttcttttattttattgtttatgctacatagaccatttgatattctcatgaaattatatgcttcattatggaggaaatctcagagcaccttactataaatttgtctcagaatcttagtgcactcacttgaacttatttggtctactaacataccaaaagacttaaaagaaaatggtttcctgaaaaaaaaaaaaaaaaaaaaaagcacaagtacaacagtgtcagaagatggggacacaaattttagcatgtgttcagtgtaatgttctcaaaggacagcagtatttgcaaatatatgtcttttggagttggagtatctatactttggctatgtataccaagactgaaaataagagggacaatagtatttatcttgaaaatctaagcacacaaaaacattaaacagggacctgagttttctcttagtgaagctttttctaagtacactcacccagacctgaattttgagcctgttaaatattctcaccagattttaatcacaggggttatttaccataccacaactcaatattaaaacctaatctccaaaccagatacatttgtattttaaatggaaatatttacactatagaattgagctgttcaatgtggtagcaactagcctcatgtagctattaaaataaaaagtaaaatgaaaattaaataaaatttaaaagtcactttctcaggcacactggccacatttcaaatgctcagtagtcatgggtgactaatgaccactgttaatggacagttcagatacagaagatttctatcactgcagaaagttttgttgtacattgctgctataaaaaggttcccagctttatagaaacgggtgttatctcttttcagtagttcactcctcaactgtattgaactacatctggatatatcattgggtggaaatatgtgggggttaagattgaagaatgtaaatttgtttgagttcattgtagattctggatattagccctttgtcagatgagtaggttgcgaaaattttctcccattttgtaggttgcctattcgctctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgaaaggaagggatccagtttcagctttctacatatggctagccagttttcccagcaccatttattaaatagggaatcctttccccattgcttgtttttctcaggtttgtcaaagatcagatagttgtagacatgcggcgttatttctgagggctctgttctgttccattgatctatatctctgttttggtaccagtaccatgctgttttggttactgtagccttgtaatatagtttgaagtgaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctagccatgagcatggaatgttcttccatttgtttgtatcctcttttatttccttgagcagtggtttgtagttctccttgaagaggtccttcacatcccttgtaagttggatttacaagataaaaacaaacaaccccatcaaaaagtgggcgaaggacatgaacagacacttctcaaaagaagacatttatgcagccaaaaaacacatgaaaaaatgctcatcgtcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttttagggacgtggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggagtggggaggggtagcattgggagatatacctaatactagatgacgagttagtgggtgcagtgcaccagcatggcacatgtatacatatgtaactaacctgcacaatgtgcacatgtaccctaaaacttaaagtataattaaaaaaaaaaaagattgaagaatgaactctcctcttgagggttttggctagtctatcatcttctaataaatacactgtcgggcttttttttctactggtcagtatgtgaggccagtggtactcccagtccttcctactcttgatacatttttttaaatgtatctacctggctatcagttggactatgtatcttcttacatagatagagatatttggtaagtgtacacttaatattgaaaacagagcagccatgtaagtctacagatggaagaaaacttgaacccctgctaatacccctgaaaagagaatttaagatcctggccccatgagaattttcaggtgatacttcctgaatggaatcataaaaatgaccaagaaaaaaaaaaagaaaaaaaaccaagggatttaactgatacactatacatatgaaggcaatggctgtaatcaccattgttactaatgtgtttttggcattccatagaatcttcttctgaggaagaaagtcctgtgactggaaggaggtctcagtcatcaccaccttattctactattgatcagaagttgctggttgacatccatgtaagtttccatcttaacacattaatgtctattattttttattttccatttattttgacttacacattctcatattcacttgagggaaaggttaaagagtttagttttttaattaacattttaaggatagattctcattgctttgtgaatacatagaacacaaaatctagaaattaaaattgaaatgggaaaacatttaatcaatcagagaatattttattttcacattcttgtgtcagttagaacatgtctgggagagtagtgataacaagctgtttgtaaaacctaatctcagattgaggggtacaggttagatgtccaacttttaatagcattccttgagtgatgaggcaatgcataaatataaaacatttagtaaaaaacagagtgtcctctgactgcataaataaaaagtcttccagctctttgtgaacatgtttaaattgttctaatgcagattttaaattgtcctaatgcaatgtgctttcagattattctatttcaattttgaattacctctatgctaccgtacacacatcccttccagattgcccaaaagttgttaaatgatacataccatacttaaaagatggatttagattaatttgcactttggaagtgtttgagatactttaagacaacccatggcacgtaaaacctgagctggtaaattaacatatcaatttcaagagctgtgtgttaatcccaatgtcaggggataaaacaaaagggaaaagttaccatttttaaggagcatcaaatctcctgttctctccagcatcaaaagcaagtgtccattcctgagctgacaagtatgggtattttttttaagtgagtaaattttgccctatgtgatccagaaaggccactaataatcacagtctgatgtttgggttttgacatctcatcctcactaaaattttggctccatctaatgagtgaacatccttgtttcagtttaaaatatatttcaaaatgttgtcagcttggaaactttccaatctagaagaaaatgaaagctactagaggctacattaacctttcttgtgcacacaggttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaaggttggtttttttgaattacttatactctccatgttttatgactgcagagctatttgcatttttggtttattttcaaaatttattaccaagagagtgacctaatttcacttgcattttagtaaatagtttgattgtcaataatgtattttaaattgttctaatgcagaacatctaattttgtgtcatttgtgtattttaaaataagcattcaagtatttattagtttctttataactggaattgtctagatgcttatgttaaaattactgccactgaatcatcctactctataaaactatactgagtatgagaaaggacaacaaagaaagtgtgtaacttaacaagcataagatgaagtcttggtatttgcaaacatagctattcatttctcaaacttttgtgatatcactatatatatatatatatatatatatatatatatatgtgaaatttaagatgatctttatctgtttaattggtggagaaattaccaagagctcttttaattttttccaaccaaaaaagtctatcaagaattccattatgaaataaatttacttttagaattaccacaggcacgtatgtttaattttgtttcctatgcaaaaagagagcattggcacattttgttaagcttagtatttttagcaattaattaaataacttagttccacaagacatgaggtatgtattgctgaacttccttggtgggagtagtagaccaatggagttctatagcaaagcagtcagtacacatgttagaaaatcaaggcacatgttgaaatgaacacaaactagatatactgcaagaagaattaatcatgttgtggttgagctaaaacataggcttaatcattcatgtgtctgtgaagttgctaatgcatgaaatagtatatatttaagaaaaaaactacatattcttgctgttaacctaatacacgcacctaacaaagaatacaagttctcttccctctgccatccaaatgcatctgagaaattggtggtggctatggctttaatcattacataagactgagaagacataggggcatttttatgttctttatcataccagtagtgttcacatagaacaaagacaagcctgggcatggtagatatgtataagacacatcctaattctgttgtacttgctaactttcaaatgtgtttttattgcgtgactttctttcattaattggagcttgttgtcagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggtaatgcaccatttgaaaagcagattgaactcctctcattgcgaatgtgtttcttcatgggacatgtagcatttctagccattccaaatagattttcatcatataccccaaggccttaaacatttttaattataggtttgtaggtggatccttattacctctaatttgggtggttcctatttacttccaaagacaaaaatctcttatttgtttgcctttattactcagatcacatatttgaggtagtgtctcttgacacacactttttaaaaatattttaaaaaattaattgacacctaataattgtatatatttatggggtacagagtgatattttaatatatacaatttgtaatgatgacatcagggtatttagcatgtctatcacctcaaacattcatcattttttttgtgtgttgggaacaatcaatatcctctctcctagctatttgaaaatatgtaatgaattattgttaattatagttaccctatagtgctatagaatattagaacttatatctcctatctagtcatgcatttggatcctttaaccagcctttctctatcactctcccgtactcctcttcccagcctctagaaacgactatttactctctagttacttgagaccaattttttagcatttgcatatgagtaagaacatgtggtttttatctttctgttcctggtttatttcacttaacattgagtccaggttcatccatgttgctgcaaatcacaagatttcattcttttttatggctaaatagcatttatttctgtatatatgtcatgttttctttatcaattcatctcttgatggatgcttaggctgatgccttattttggctattgtgattagtactgcagtaaatatggaggtgctgatagctctttgatacactgatttcctctttttttgagatatgtacctagtagtggaattattggatcatatggtagttctatttgtagttttataaggaaccacaataccattctccattgtgggtgtagtagtttacattcccaccaacggtatataaaagttcccttttctccacatcttcaccaacattaattttttatgttttgataataaccattctaactaggatgagataatatctcattgtggttctgatttgcattttcccgatgattaattatgttgaaattttttttcatctatctgttggttatttctaagtcttttgagaaatgtctattcaaatcatttgtccattttgtttattatactttaagttctagggtacatgtgcacaacgtgcaggtttgttacatatgtatacatgttggattatttgcttttttctgttgagttgtttgagtttcttacattcaggattttaatcccttgttggacgaagagtttgcagatattttctctcattcttcaggttgtttcttcactttgttgatcatttccttttctgtgcagaagatttttagtgtgatataattctatttgtctatttttgcttttgttgcctgtgctttggtcctattcttttttcccaaaccaatgtccacaagcattttcttatattttctagtagttttatggtttcagatcttacatttaagtctctaatctattttgagttgatttttttataaggtgagaaataggggtctaatttcagtcttttgcatatggatatttagttctcccagcaccatttattgaagacattgttctttccccagtgaatattcttgatgcctttatcaaaaatcaaccacaatgagataaatgaatatgtggatctatttatgggtcctttataccgttccattggtatgtgtgtctgttttttggttgctgtagttttgtagtatattttgaaatctgatattgtgatgcctctagtattattctttttcctcaggattgctttggctattctaggtcttttttggttccatgcaaattttaggatttttttcctatttctgtgaagaatgtcattggtattttcataaggattgcatagaatctggatattgcttgggatagtagggtcattttagcaatattaattcttctagtccatgagcatatgttgcctctccttttgtgtgtgtgtccttttcagtttccttcatcaatgttttatagtttttcttgtagagatctttcacctcattggttaaatttatttccaagtattttattttgtagctactgtatatgggattgtttttgtgatttctttctcagctaggttattgttggtatgtacaaatgttacagatttttctatgctgattttgtatcttgcaactttactgaatttgttcatcaattctaagaattttttggtagtgtcaaaggatattctatttataagatcatgtcatctgcaaacagacactctttgacttcctcttttccaatttggatgtcttctattgccttctcttgccaaattgctctgattaggacttccagaactaagttgaataagagtggtgaaagtggatatttttgtcttattccagttcttagaggaaagaatttcagcttctctcattcagtgtgatgttagctgtgggtttttcatatatggtttttattgttttgaggtatgttacttccatacccaaactgtggagagtttttatcacgagggaatgtagaattttatcaaatgctttttttggtatcttttcacatgatcatataatttttgtctttgattccattgatgtgatgtatcatgtttattgatttgcatatgttgaatctcccatgtatccctgggataaatcacactcaatcatggtgtataatatttttgatatggtattggattcagtttgctagtattttgttgattatttttgcatctatcttcatcagagatcttggcttgtagtttttgtttgtttgtttgttgtaactgttgtgtccttatctggttttgagatcagagtcatactgacctcacagaatgagtttggaagaattcccttcccttcaacttttttggaatagtttgagaatcgacattagttcctctttaaatctttggtagaatgcagcactgatgccatagggtactggacttttctttgttgggagactttttattgctgattcaatcgcattattcattattggtttgtttaggctttctatttcttcttggtacaatcttgctaggttgtatgtgtccaggaatttctccatttcctctagattttctaatatgttgctgtgtagtttttcataatagtctcttatgattctttgtatttctgtggtatcagttgtgatgtctgcttttttgtttctgattttatttgggtcttttatactttcttgttagttaatctagctaacggtttgtccattttgtttatcttttcaaaaagccaaatgttcatgttgtatttcttctgtattgtttttgagtctcaatttcatttacttttgctctgatttttattatctctttatttctattaatttggggtttggtttgttcttgcttttctagttcattgaggtgcatcattagattgttattcaaaatctttctacttttttaatgtagtcatttattgctataaacttgtctcttactactgcttttgctgtctcctataagttttggtgtgctgtgtttctatattcatttgcttcaaataatttcttaatttccttcttatttattggctaattgatgttcaggagcatatatttttaatttccatatattgttacagttttgaatgtttctctggttattgatttctagtttattctattttggtcataaaggatactcaataataatgttgatttagaaaaatgttttgagacttgttttgtgtcccaacatatggtcagtcttagagaatgtttcatgtgctgatgaaaataatgcatattctgcagctgttgggtgaaatgttctataaatgtctgttaggttcatttggtctatgctgcagtttaaatccaatgtttctttgttgattttctgtgtagatgatctgtccaatgcagagagtgaggtgttgaaattctcaactattattatattgtagtttatctctccctttagatgcaataatatttgctttttatatctgggtactctagtgtttggtccataagtatttataattattatatcctcttgctgaactgatcctattatcataatataatgtccgtgtttttctcttttttacattctttgacttttaacacctgttttatctgatataagtgtagctattcacgcttgcttttgatttctgtttacatggaatatctttttccatttcttcattttcaatcagtgtgtgtcattacaggtaaggtgaatttcttataggcaacatataattgggtatttttatttttttatttttattttttttactttttaactgttctactagtctatatgtttaattacagaattttgtctgtttactgtcaagtttattattgatatgtgaacacttactcctgtcatttcgttaattgtttctggttttgtgtatccttttttttctattctcttattgttaatctatgttgttaggtaatcttttgtagtaataaggtttgattcctttctatttcacctttctatacctgctttacaagttttataatttcatgttttcatgatagttgttattgtgtttttcctttcagatgtaggactcccttaagcatttcttgtaagacctctctagtggtgatgaattcctctgctttttgcttatctggaagaggctttatttctccatttctgaaggattgctttcctggtgatactattttgggctatcaggttttttccagcactttgaatatatcatcctattctctcctggcttgtaaggtttctgttcagaaatctgctgttagtccaatgaggatttccttatatgtgataagactctccttttgctgtttttagtattctctctttgtcactgacttctgacagtttcactgtgattttctttgggaggacctttttgagttgaatatatttgataacctttgagcttcctgaaactagatgttcatatctctctcccaagacttgggaatttttcagcttttattttattaaataagttttctacatcttttcatccttctggaacccccataattcaaaaatacatcctcttaatgttgtcccataagttctataggctctctttattctttttttttctcttttttcttttctgcctgaatcattttaaaagacatgtcttcaagttcagaaattctttattctgcttggtctagtcagctattgaagctctgtattgtattttttaatattattcattgaattctttatcttcaatatttctgtttggttcttttttaatgatacctattcctttgttgaatttctcattcagatcatgattttttaaaatttcattgatttgtctatctgtattctcttgtatcttgctgaatctccttaagatcattattattaattccttttctggcacttcactttttcttttctgttgggtctgctactggaaaattattatgttcctttgaaggtatcatgtttccttatttgttaatgtttcttgtgtccttgtgttgatatctgtccatctgatggagcaattgcttcttataatgttatggagtggctttcataaggaaagacttagtccatagatgggtcctggggtgttggttgggttgggtgcattgactttggttctgggtggatgcagcagtgtggtctctatgctgtaatatacattagcaacgtttgctagtacctcactggcccaggctgcaaaagtttgtggcagaggtggcacacctttgccaggggtgggcttgccaggctgtttctcagtccagaggcaaaagtgcacatgcggtgggttgggtggctcaggaatttgccctccagtgttgagctatcagactacttctctgggcaagagtgtggtcacacagggtgggaaagctagcttggggtctggcttactgggatcagtgctgctgagctgtttctctggccagggttgcaagtgcacagcagttaagccagcctagagttggcttcgccaatgtgcagtactggagttatggctgacctttcctgggcccaagatctgagcagtcagggtcacagcatttcagccatcagttggggcttggtgaaatgacagtggagctgcaagactggagaggcacagtgtttactggcccccagaacatagtgtatttcagcagtgcctctagattcaagatggcaccaggctgcagcagcttaggtcatgggttggtgggaaatgcacaacttttgctccttatctggagcaatgcagacacatgaatttcaggcaccttcccaaactgaactcagggcttgtgaggactatgagattctcctgtagtaagtactacagttgtctgtggtggcaattggggctgatgagagtcttctgcttaccttttcccaataaggagaatttattccgggctctgagctgatcatggtaggggagatggggcagcagaagcagagtacctcacttccctctctttgctgccattttgagattccatgctacacagtgacctcaccaccccatcactgcactccaacactctccctcagacacaccagttgaactctgtttattcattctctttgtccttttttgtgagggggacaagcaccaggtgccaccaataagctatcttactgacatcactccaactggaaccgattatttttttctgagtttttttttattgtagtaaaatatgcatatcataaaacttaccatttcaaccatttttaagtgtacaaaccagttggatttattacattcagaatgttgtggggttgtcaccactatccattttcagaacttattttttttaccatcccaaacaaactaaacaattaagtcttgtttcccccctcctctaacccctgataacctctattctacttttttttcttggtgacttatataagtggaatcatacaatatttgtccttttgtgtctggcttatttcactttttaggttttcagagtttatccacattgcagcatgtatcagaatttcattccttttcaagggtgaataatgttttatcttatgcattcaccacattttgtttatccatttatctactgatggaaacttgggttgtttccaccttttggttattgtgaaaagcgctgctgtgaacattgatgtacaagtatctgtttgagtccctgctttcaggtttttggggggtatatagctaggagaggcattgctatatcatgtaatcaggctatgcttaacttcttgagcaactgataacataaaattttaattcaagaaatatactgtgtttagacaatgattttgtcattcacaaaacatttattgactttataaataggtttaaaatattcaagtagttcacagatgctacatcaatagaaattatcacacataatattttctgaaccatgtggtatttgaactcattcttgagaaatggggagtatctggatatctgaaaacacaggtggaactccagacagaaaaaagattatgccagtctactcccctagcctattttcttgtcacacaaactggctttggagatgccatgctctttcatgaatcagcgctcctgtgcaagctgtttcctctggaaggctgccccctcacctcttctctgcttggtaaattagtaatccttcatgggccaaattaagtatcaactttgacttcccaaggcagagttatatatcccttcctttctacttacaaaccttttgtccatagttccaatttagtacttatggtattattgttagttattttatttttttgctttcatactatattgtgaactcttaaaggaaataattatgtctaatccttccatgattatttgtctaccaactcacccaacttcagtgtctaaccaaggacatggcatatgataggcacacagtaattatggaataaatcaataaagtttgaaaagaaagaaaaaaaggaaggaaggaaatttcctggatggtttctaatgggaaagcagtgtcagtgggaaaatatctatgtctgtctatctatctatctatctatctatctatctatctatctatctatctatcttaattaaagacattaaaacaggatgtcccaacataagtttcatagcaaccctggttatatccagttatctcaaggaatgttttggaaatttatagaggaagtggatcttcctttcattttaatttaaaaaggacgtgatgtcataccatgtttttgtggttgaaaaggtcataaaaaccagtcttttgcagaatagcacagctctctcagtgccaagaatcactgtttagacacaaagatgagcttatcaacagaataacttaccaacaatagttgacatattttcccacaggacagggcataccacataaattgtcacatttcgtggcttttatccttgagtatcttctttgtaagttaatggaagccagctacattttcagtgatgcatgtttacgctcttggatttgtgttggttgatttgccttcattttctttatcatttgaaaattatttatgcaggtttttcatgctttcagttttgtgaagataccttaaagcagtagaacagacacccccacactgtgctttatattttttcaagaggctgtttggcatagcatagctggatgtatgctttggaatcagacagactttggcttcaaattctgcttcccctacttactagtactatgactgaatacattatttactgtctctaaattttaaatttgtataagtaaattggagataattatacttacttgttgggctatggtaaggattcacaaagatatctaaatatcatgcttagcacagtagctgatacatggtaaaaattccacaaatgttaggtctcaaattgtacagttgggaacctatagctccttgcttttctcctgtaccatcagtcatctcaataataggttagttttctccttctgatgacattgttgagtttttctagtaaatgtggattttataagaatgtagatgttatagatcttgcattgtgtttttcaaacgacccctcactaggcatatttctcccactgttaacctactaatgaaataaaaattggtttttggacttcttttaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatctgtgagtgtgttcaatgtaatctctaaatgctactatctgttcacttattaaatagtgtttaaccactgcttcatgatctgttaggaatcaaattattctcacattcacttgaaataaattcagattgatatatgcttttaaaacatctactctttactgaatctttatggtacctaaatttgagctacaattgagaaattgagtcccttatatggatttatgtgtgttttctaatcacaataacttaaaatatattcgtgttcaacaatgtattttagccatcacgatttgtgttatctgatggtttcagagttactgaaactatacttccagtaaaaaataaaatacaataaaaggaaagaaatttatttgtttttttattttgaaataagatctcgctctgtcacttaggctggattacagtggcaggatcatggtacatggtagcctcaacctctgattcttaatgatcctcccaccttggcctcccaagagctgggattacaggtgtgagccacgacatctagccaaagaaaataaatttggctaagtcgtgtctcatttgcggaaacactgtagcatataaggtgtacagaggagtaatttaaaaaaaatttttctataactccatcaggtgcagatttttctttaaaaaaaaattctgtaactccatcatgcacagaactagtaatttcccttattatcttccccttacatctttgcagtatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggtgagtttgttttgttttcttaaagaatatatttttatgtagcaaacctgtgaaaatcatagacataaaatatttgcttactcttaccaagtcattacaataaaaatatatttatagtagttaatttgctcagaattggttttgctgattttttttttcactcagtgcagtttgatgtttgaattgacggcccccacctttgtattctatttcttttaaacctgagttaacttggatggcaggtggatcacgaggtcaggagttgagaccagcctggacaacatagtgaaactttgtactaaaaatacaaaaaaattagctgggtgtggtggcaggtgcctgtaatcccagctacttgggagactgaggcaaggagaattgcttgaacctgggaggtggaggttgcagtgagcagagatcacgccactgcacttcagcccgggcgacagtgcaagactctctctatatatattatatttattatattttatatatatatatatatacacaactggactaggttatgattgtttgaaagtttaagtttcgtatttctaatttagggtagtgttcaacatgtgatactttatgaggtattccaagaaatatttctgcaggatcttgtttttaaaaagccttggaaatttgtagagaaagttccttctataatgtcttaactctgatagactttttaaaatcctttttttcagaagaattataaccacattggcaatgctgagacaatattttaccgcaagccaatctgaatcataaatgaaacaaaataaatgaattcaagaaagggagaaatccaaagtaaatgccaacctctgtcttgcaatttcatagattttgcttaatgtatgattgaacaaaggacagggttttaaattaaaaatagaaaagggtaacaaacattgtaattatgtggattaaagaatttttaaaaatcatctcaaagttctgctaatttagtgtgtcaaacaacaagatagcatgaatatttcagtctggcaactacctagaaatgtagttaatgtctaataatccattcttataacgtgtaattttatattttgaaaaataaaagattatagtaaaaattggctatacttcttcctccttctctgattcccctgtgagaagaagatgcagctcctaaacatgccattggccatgagttagagaactgattaaagacagagtgagaaaatgaaggcaaaatcacttaagttttctccttatgctcatggagcacaggtatgctccaagtgcaaggaggactgtgaaattttatcttgttacattacttggctggttatttcctatgtcactttatggtgaaaagctcccatagtagtttgaagtgtaatttaactttggttctgtcttctatttcagtcctcttatttggtctttaaacagtgcttatatttgaacaaatagagccagtcaacaaataaaagagagtgtagaaattgagatccatgaaggcaggaactaatttcataggcatttggcaacggtaaatttttaatatatgcatgaacatagaatcattcaatttaaaaacaattatttacatataattattttaaaatcattcaaacatttacttatgtttagagatgagaaatgagctgaattgaactctttgtatgtgctagactaagaatgtttaatgataattttcaaaaaggttgattgattttgataaagttcagaacactactaaagggtgctaatatatccataaatttccatttgtgagatggcataccagatgccagccagtggaatactgccagagggaattatgttctatatttttatgtatttcattgaaatttgttctgttggtagagagtacatagttacacagtatgaggtgaatatagcctaaactgataagtcatctttacatagatcagcatactggaatagcaaaaatagtaatatagatgcaattatgaaaaataatatgaggtgaatatagcctaaactgataagtcatctttacatagatcagcatactggaatagcaaaaatagtaatatagatgcaattatgaaaaataatctgagctaatatagcactttttatatatgaacaggagtcaatttgctgttgggaacccgatctaatctatatctgatggacagaagtggaaaggctgacattactaaacttataaggcgaagaccattccgccagattcaagtcttagagccactcaatttgctgattaccatctcaggtttgtttaagaactaaaattagctgagtaattatgcagattaattagtctgcaaactgggttaaagactttctcaggttaaagtgttcctagaagagcactttaaatataacctttaattgggacaccagactttcctacttatattatcttatctatttacaatttaaagtaacttccttttattgtaaagtacctaacctaggttactgataagaaaaaccacaacatttgcatccttgcatgttctctccagtgcagcctcctacaacttcagatttctaattttcatccattcatgcacaggactgcatcaacatccaccatgtcccgttcttgtgaggtgttagaagcaacaaagaacaaagtgaacaataatcagatacaaaagagagttgtccttagtatatagccttatcacaagggcctacaggtagagtttgtaacaagaatggatcccctaaagatctttacaccttttccaaatagtagttaaatttcttagttttggtcagtcagagcctgaaacttagaatacaagaaagcaagtaaatgagtgttaagagtgatcgtgattactaaacagcatttagtatcaggaaagcaccaacattaaagctgactataggcaaaagatgactgacaaaagagagaaaaagtaagaaaatatggtttgtctatgtgaataaaatgatgctaatcacagacacttatatgagtttatgtattttattatatataacatgctttatatataattagtgcacaaattgccatgttgcacactaatgattttgtgttattcctaaaatgattaactttgctttacattttggttagaggagaaatccctttagaggtatgctcagacttcatgattttttaaatcatgttttatagttagttgcttataattgtttaaggtacgtagaagtaatatttattttttgaaaacatctgggtggcttatagactacatatctgtataacagatttctttactttttatccaacttcctctaacccaaatatgttcttctctagttcttgagcttctctcaaatgtggaatatttttccatcaaacagtactgagaacatcagtataagaaggtactcagtagtttaaagcacaaatttattttaccatttaagaaatagaatagcggtagtgttttagtccattctcatgctgctataaggacatacctgagactgagtaatttataaaggaaaggggtttaattgactcacagttccacatggctggggaggcttcaagaaacttacaatcatggcagaagggaaagcaaacatgtccttcttcacatggcagcagcaaggagaagtgcagagcgaaggggggagaagccccttataaaaccatcagatcatatgagaactcaatatcatgagaaaagcatgaaagtaactgccccatggttcaattacctcccactgggtccctcactcaacacatggggattactatttggattaaaattcgagaccatatcacatagatgtagatatctgaaccctaacactgcttcaaaaatgttgtgtaaaaacatatgaaagactaatcacataagtaagaatcctattgttgggcctagaaatcatgtaataataaaccataaaaatgacaaagaaaaatgattataaagtcactatataggggaaaagaaatgtgtgattttttcatggcctgtgtttcctgactgaattgtaagaatttgatgaaatttacaattaggaaattaatattaacgataaatttagttggaggaaaatataatgaaactgttcaactattttacaagcatgctggaatgacagaacacaaagatacccatattgctgtccctgaataccttaacagtcaatattcagccacccctctcgtacacacacactaccagggacagcttttaggtctctgaactccagaggagttatgacttcatgaatagccaaggtacaaatgaatggatggtaattatcttgcctgcatagtggaaggcttaacttgtcccaaaaaaagtttagatccccttctgagaggcacataggtagatactttgactatctcttggaattgagagactaaaataatctgtcatatttccaaatcctgaatgggagattctgatgcaatgcagttttttttaaggtgctttttacgttaataaagatatttttaaaaggcaaaatatctttacttttttttcttctaatatatgaaaagaaagactgattttaaatactgtatattttcttatctatcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtccgtaagccacatttcatgtttactacagctatataaattttgcatcctttcatttggtgaactacataattatgaaaggcaaagcagagaaaggaaacaatttgcagtttcaaatacagacgagatcagggacgttcagggtggtatggctatagacagcaacttcaaatcaaagaagagtaaatttcactgacacatcttccaggtcttctatgttacaatcttgatttttttttttgagaaaacattgactgactaaaatagttattgatgttaggtttggtttacctcctcaccttactttctttcccagtcaccccgaatattccagataaaccgatttttttttcctgcctttatatagcttcagctatataaatggtcttgatttatcttcacaaacttggggagatgcatatgatattctctttctttggagcaacagtaagattgaatccctcctaatactgtccaggaaacttaatgatgagtcagaaagaaaattctgtgatctgctggctctcactcccactgttgatattaatgaatataatcactaattgttttccatctgattagaatgttttcatataccctgtatcttcacaaccatccactgtgaaaggatgtaacaaccctaggggttcagaatcctgctctcagctataaaaaaccgtgagctaatgtcatcccattctgttctatttctgaagcaaatccccctgtactctcagccttcttttgcttctttccctcttcattaattgcctcttcaggcagaactggtggcataggtgagaaatagctggaatcacattatataaattgcaatgggatatttctgtcctgactgaccattattgttctgcatataaagtgactttctcagggtaggtttttgtatgtgtgtgcatatgtacacatacaccactaaagagggaaatgagtacccagataatttaagcattaaataaatacactagtttcttccaggtttaggtatcactacttccctccaaatcatattatgcaaatgtgatagtcctacaggtgaaagatatccccagatgttaactcaggagtttatatagcaaaactacctcctcctaacttgtaaaatattagttcagtaagagatagtcacaaagttactcatattgcaaatctgtgctctttgtgaggggtggactagttaagtttagttttcctggctgaccccattccagtccacctaagctctcagaacagcaaaaagcatttgtcccactgacaggtggaattagtagcatcttcacataggaagacaagaacaaatcatacttgcctggtattttcatagccttccaagatccacaagacagtgaactgtcaccaattactaccctatattaaatatataggaagtgttttcttaagagagaatattttttattattggaggattagtaatcatgctcctttgacctacttgggagcaatgcaaaagaaaatgcaagagtaagctagacccagagagagacagaaagagagagagagagagagagagagagagagagagagaatgcgtagggatggcagaagaaattgcagccaagaaagggctttatagcacaaagtataaatctatcgggtaagacaacatattccataagaaccagaagggctaatcaagagcaagcatatacctatttatactttttaatttaccttttaaaataaccctattgaaataatgtacataccatgaaatacacttgtttaaagtgcacaattcaatgggttttaggaggtctatagagttatgtgacaatcgccatgatctaatttttatcatccccaaaagaaaccccatattcattaacagttacccccattccatccttctttacttccccctctaccactcacagtcctaggtatccattgataaactgataaatggttacctaggactttctttctctattgatttgcctcttctggactattactataaatggaaccatatattatgttgtgttttatgacggacttttacttagcataatattttcaaggtttgtctatgttatatataacatgtatcagcaattcctttttattgctgagtagtattgcattgtatggatataccacattttgtttatccatacatcagttgatggacatttgcactcttcccactttttggctattaaaaataatgctactacaaacatttcatacatcttcatatgtggatatgtatggtttttttctcttggatagtatcgttacactgtttttcaaagtggttgcaccgtttcacattgctatctgtaaagtatgagagttctatattctctatatccttgtgagcacttgtaaatatctgtttttttattctagccatccccatgggtgtaaagtgggatgtcataaaagtttcaatttgcagttccctcatgattaatgttgttgagtatcttttcatatgtttactgaccatttggagacatgtctattcaagtcctttgcctgttttttaattggtttgcttatccttttgctgttgaattgtaaacattctttaagtattccatatactagagtctttttttcttttgaggcagagtctcgctctgttgctcaggctggagtgcagtggagtgatctcagatcactgcaacctccacctcccaggttcaagatattctcctgcctcagcctcccgagtagctgagattacatgtgcttgccaccacacccagctattttttatatttttttttttagtagagatggggtttcaccatgttggccaggctggtatcgaactcctgacctcaagtgatccacccaccctggcctcccaaagtactgggattgcaggcgtgagccactgtgcccggcccatatactagactctcatcagaatatgatttgcaaatattttctcctattctgtatgttgtattttcacttccttgatagtttcccttggtgccccaaatttttaatttttgatgaagcctaatttatcttttttttccttttcttgccttatatttgggtgtcaaatatcagaattcattgctatattcaaggtcatcaagatttatccctatgtttacttccaagaattttattgttttagctattacatttaggtgtttgatcaattttgagttaattttgtatatggtgtgaaatttggactccaaccttattgttttgcataggtatatccgcttgtcccagcaccatttgttgaaaagactgttttttccctattgaatggtataacaccattgaccatagatgtatgggtttatttgccaactcccaattttattccattgatctatatgtctctccttatgttatttagtaccatactgctttgattactgtaacttgcagtaagctttgaaattggaaagtgtgagttctccaacttagattttctttttcaacattgtttggctattaggagcttcttaagattccacgtgaaatataggatcaacttttccatttcttcaataaaaggccattgggattttaatagggattgcattgaatctatggagacaattttggaccgtattgctatttcaacaatgttaaatctacctatctatgaacaggaaaactttttccatttatttgggtcttctttaatttctttcatcaatgttttggtgtacaatttagagtgctcttgaaggcgaatatgtatactccataaaactatacagtaattttgttacctttttgtgggcatcaaattgtaaccaagtagcttccccaaaaatatactgtctgtgctcttaaattgtggttatggcattttttatgacaaatacaaatacttgagtgttcttgttaactgtggcatcgttacttttttgtgttttatcattatagtccaacatgaagaaacaacatatattgcaattgctttgaaatcatcaattcacctttatgcatgggcaccaaagtcctttgatgaaagcactgctattaaagtgagtgagctcctttttctttggattatatgattttttattttgagaagaaattgtgaacagaatcgtaccttggaatacagatgcagaagtatataccattcttctatagttaatgaaattttgttgttagtttgcttgcttgtttgtttgtttattttttagatacagggtctcactctctcactctggcccaggctagagtgcagtggcatgatcatagctcactgcaaccttgatctcctgggctcaagccatcctcccacctcagcctcccaagtagctaggactacaggcatacatcacacctggttaattttttaatattttgtagagatggggtctcactaatgtaacttgaatataccatgtcagtaattactgtttaacccttttttagacaattcacaggcatcacagcaagggagaatgcgagggaaatccctggcccctccccttataggacctccccaccagcgcctcactcccaattcctgtagtcaatatgaagaccttctctttcagagcctcaaacacaggctttgggtgccaccccaataaattgaagctgagaaagtccctgttttctcttagtgggggatagagagcagagggaaggtaaagaaaggtatggtaatgatagagggggaacacccttggaggaaaaaggagggaaaagaaagcctttgctccagttaccatggccacaatatgtgggtatgggaaggggttggatgagtctatattctttccaagctggaactctaaacacatttctctctctatctattaatattgtgagacatggtggttaggcttaccagtactctttctaactttattacagtttggctgaacttctatggataggccacataaataaacaattgagtgtcttaaacaactaaccttaaaatgagggactgtttttatctagagtaacttacttataatgctccagaattctacttaaatggaattattttgtatttattccatagtaatgagggttgactaaagaactggcagcattctatcatgtccagtagcttctaacctaggatgtatatcagaattagctggaacatttggtaaaggtttagatctcagacccaacaccaggctgaattagtgggtctggagtagggtctgggaattgatatttttagcagatgttccaggtgatttttaactagttgatccatagacaggttttaacaaagcactgatagggacccatcctgacagacgcagcaaggtattcatgaaatacttttgtatcttaagtcaggatctgtttacatggtatattttgtaagggaacacatcacatgtatacaataaagatgagcaaattcttatgactacctgccaatgtctatttgcataataactatgttcttctataaattatacagatgactgtatatacagtctgagtcaaccctaagacaaatcacgtcacatccctgatctgatctccctaaattgggccttggttcagctgtcagtatttggatatgggtttattcttgggtgtctgctgattggtcagagctgcctggtatggagctggaaagcgaagaaataagtaccaacagtctgtctagcctgatacacagttcttgtccaagtcctcactgcagttcttgactcccacctcacaactacagtatgttgaatcctgtgatgctcagtcctctaccgtgatctgatcttggcaatgaatcctgtttggccttttgttttggactagaaaccataggagcctagagtacatacccagtatatggtaggttaacatgtctggcccttttcattccctaccaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggcaaggaacttgaagacagcaaacagaatgcagggtcatacaaggctcttatgatcattgccaatctgacctttgaagagaaactcaatattttgaagctattgaacataattatttctttgttgtaataacaggtctaagaaaaactgtaatacacaggtctctaaatacaatatgccattttaaaaatccacctgggttttgtacacttataaacctgacaaaagagtgagggaatttttgccttagttagaatgtcatttttggccttttggccatatttggttttatattcacaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatgtaagataacaccttcagattcctagaaattattgtataccaccatttgagtttttccaactgtcaaaactctgaaaggtttaaaaatatgattagtaatgtctataccggaactgagacataaaaggtaagtatagagtgccagaaagtggtcttgcataaacaaaaaacactgatgattccttagtttagaaagctgagtatattctgcagatagattttgcttgtcttgcctaatttttttttatttttaatgaataaagtttacacttaaactctggacttctattgctacatcagaagaccagatagcatcagtgccacattactatctagccattatcaattggaatgtattcattcatagctccttttagatgggatatgtgctctacattctctacccatttatgtttatatatttataataactgaccataaagtgtatttgattttgcagtacttgctttagtttttctgcacttcacaatgcattaacaaatttttaaaaaatacaacaccagtattgcagcattattatgtgtattcctattctttattatattacctcaacagtgacataacagcaaattatcataaaatgttctcttatctggttaattatagttagaatttctgatcaaaagattcagcattttaaaagcagatactcctcaactcttaaatgcttatattttgtgaaatacggtgcaacacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaaagaaatacggtgcaacatctaaaatatagattgtcataaaaatattatacacatcatttacataaagagtttgaacataatgtaatatccctcacacacaccatacaaaatataattctactgtgtctcaaatttgatgttggcaatgatgtttgtcctattgaaatttttatttaaaaggaaggcctaaaccaacagttctctgcttcactatatttaaattcccaatttttagacaaccaaagttttagcagtttagcattatacaaaaagtccaggagaaaactttgatgtattttcaaattactacagttgtgtgatattttgaacagctctcagaattgtctcatatgtctctaacaaattacataaaccaattgtcaggacattagtggggacaattttgtaaaactcttttggtcatattaaagataattagcttattactcagttgttgcccatgattatatagaaatcacactgttgataatgtataaaatactgaaccaatcttagccaaagccacttaaacgtgaggtcaagttaattttgatatagctattgttgtactcttcagttggagtgtcttccgtagcttcctgcatctctcttttttttttaaatgttgcgtcagatagcttttattaagaagctagtgcagtattgaactttgcagcattggtccatgtttacacttatttgaaaagtaattcaggaatgttgacccgcgtgtttcacatgattaataagcaaggaaagttatttccttttgaagcaatttgttagttagagatgagttcttaaaaatcactttctgacccaattaggataccttgtgtatattcaaaaatatttttagctaaatactctagtgtcttgacccatttaaagagaaaggactctaatatcagggaggggggtgtcttctgagaaagaatataataaaaatactatttttccaagagtgctagattacaaaagctgtaatgatacaagggaaccatgtgtgctaaagaatatctagttacttcaggaatcatctgagaagcatctgaggctgtatggatttgcagcagtccagtttttttctaaacagattttattaagacaaccttctttcctgcaatttcttttactctcttcctttatcttttttttctgattcaattgctcatgcaagtgcccagggaacgcattaaaattgcttttcgtctctggatccccattttagttataaggattgttgttgctgggacatggcctcaagcacctggcctgagtacgctgggtttggcaagtatagtttctgacttttttttttttttaatgtgctagtttgaagaaaccatagaggaacacaatttttcatttgtagggaaatactgttaatgtgacaatatctgtagtttaagaaaactttattgcattgttttatgcatcatgaaatttagaaatgcttagatatttcttagtttttcatattatgtcaccaaatatgtctttgaatgtgtatcttaagtgcatttgaaattatattaattggaaaagaaattctaacttttttgcaaagggggaaatgacttaaagttatatttcaagctgtgaagactattataaagctgtcccttgtaaacattttaagcttaagctattttttagattagttttctatttctaatttgagtgagttggctgataagcaagtattgtatatttgttatttgatttgtacattaattactaaagtatttattaatgtgttatcttaaacccaagtctataacaagtagtgtttcttctattatgatacataataatttgtgaaatgtcaagaaatctctttgtgttggaaatacatctttgcttttttaaaataaggctttctcctaattataaagaagaatatttaacagttatgaatttatgacataaagaaagcagctctcttcaaatattggatagcatgcttattactttggaaatagaggtttctcttcctccttgctctttgaacctcttttggtctttattgctctgccaagctgcttcgattaaagtagtagtgataaaatattggacatataaatctttatgaaacataattccagcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctataggtatgtatacaatttatttcttcttcaggaccccagagaaaatttacaagggtaaaaaagtgtcctaagaaaagatttcctgaattattacattttcttaagacacataagattagtttggggttctgcataattattctcttagtaaggtgatgcctgtatttgtcctatgcttaatgaattcgtgagagtaccacaaagagactcattttggttatctgagttatttgcaatattgtataactgaaatgagagctaattcctttccacaaaaatctataattttgttttaactccctttacttgcagactttacacagatattggaaatgcttcttttcatcacactgattgtggggtttatctttatcttaggagactgccaactagtataaaagagccaaatacttctattttttatagtcagtagagttctattttgtgagtgatattcctgtgaagaatcaaatcatttagaaaagtgacagatatgactgactggagtgcttgttaggtaccaaccacgtggcaacaaagaaaaatgccttttcaccttcatcaaaccaggatatttttttcttcctagccaaagcaggactgctgatctgagaaatccaaataatttgagattcttgtatatgttctgaggctcagtgaccccagacgtgattctagatagggaacataatgcatacaaaaagtaaatatattagagagagtagaatgattagctggaggatagctattatagaaaagagaagtttaatggagaaaataaaggaaaaaggcagcagtgtgtgtgtgtgtgtgtgtgtgtgtgtgtgtgtgtgtgtgtgtgtgtgtggagagagagagagagagacttaacaattgcatcagatattactaagtgttcccatttccaaaacattgtgtcccatctcagaaagcaagctagctcagtagctaggttaagtggcagatgtaggtgttttgggactaaggtggaaattatgcgatgtcatatgaactatgtacttggactcagcaaaaagcctttgctttaggtttagaatttttagtctatgttgttgttgacaacatagagacagagagagagagagagagagagagatggtctgtcaaatgagaaggcagatgcttctgagatctctataaaatgactaaatatgatcctcatgtggctttaaggaccattttgaaagaactgctttttaatgaacattttttatatgggatgatggcactttgcattgcatctgcagaatccttcttctttttttttttttcatatatagtcagtttaaggattgtcctgaaaacctgctccaatttcctcaaacaagtaagaactcacagaggttttaaaaccactttaagtgacagaagataaatgcttacagtataattgacagattcggggcaaaagaaagtaaaaataatgactcatgttctatcctttacagtggtacttttgtgatcgatatgctaatcagaaatggttataaggaaattcagttcaaataggaaactgaacaaacccttatatttatgccagtagacaatcataagggtcaaagggatcttgagaagtcatctggtgcagctcttgtcctcagacaggacaacttctgacctaaaacaaaaaaaagctactttaagttgctagaatttgaaagacagctacacgtaaaataaattacagtactataagaacatgatactttagtttgtatattaaggatattttgagagtatgctaaagactgtcatataacactgatattaaggagatcaattactgtattattctgtctacaaacaactgctttgttatttaaaactaattcagatccagatttccccaatttaaattttatgttttcttaagttataataaatgtgttcaaatcattgctctccatttccaaacaaatatgtacaggcttaacaattgcatcaggtattactaagtgttcccacttccaaatcattgtgtttcatctcagaaagcaagctagctcagtagctaggttaagtggcagatgtaggtgttttgggactacggtggaaattatgcgatgccatatgaactatgtacttggactcagcaaaaagcctgtgctttaagtttagaatttttgatctatgttgttgttgacaaaaatatcatttttaataaagtagtcacataggtgaagaaattcaactctagatagactagatctgttacttgttcccaaccctctggagactgattttccttatttcccttatatctggagttattttaattctagtctgaaatttgacttataaagtcttcttccaggataaccatttttcttagtcaacttattccttttataatagaaaaaatgaaaaatcaaagtaattaattgaattctgattttaatcatgttaatatgagaatgaagatgccttattttgttgtttcctagactattttaatttgagtttaaaatcttgatattattttaaatgtcaggattttatttacttatggaatttttccccatgaagtacataaagaatattaaattgaaagttaaaaatgtaataatagtgctgttccttgtgtcaaaaaataccttgcagcaccagctgactgactgtttacacaattaggtttaaggcaattattgtcataatctatatttgtcacaaagtattataaaatagagtcaaaaaagttaaaatcttaataaatatttcctgagcaggaaaaaaccttaagaatatcaaattagctttggttctgcttacaacatgataatttattgaattgcattagggttgctacagtcattatttgagcaagtcattttttaactattttaatttttgagagtcaggttttcatgtacgtcactggagcacaaatatacacccttattaggagcccttattaggaatgctgtatgtcacttagactataaaatgaagagtggctgtgagtagatcacaatgtctacaaatgggatagaattagttcttagctttttctatggtcttagaggatatgaatacaagaattaaataactgagacctggtaattaaatgttgattacaatggtgcctttagatagccagtttgaacaccactcttgagcagcaaaatggccaaacaactgactacaggagggaaaaacaggatgtgctaacctgaactgtaacaatgagcctcttaataaacaaacattgactgtagttataattttctatgatggccagaaagattttgtgtttttctgattttttttcatttgtattgtagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaaggtatagcttacaccctccagttacagcaaaaataacgcaaccattgaaaatgaaccaacaaaagaaatttctgtccttttccttctggctataaatatatttgtggtatattttttcaaactggcatactattgattaaaaaacaattttatattttgcagtagaaacgctaatttggtaagtgatgaaatttggtttcaaaagaagctcattttgaaaaaaataagaaaaaattctagttatgtcttaagcaaagcttagccattattttatttggttcgaaatcctttattgtctttgattcatagtacctttcatgttcatattaaaatgatatttttaaacaaaatgcttgagcaaatctgccttttatagctttcaacataattcaataacagaaggaaaatgtacttatgtttactgagcacttaattgtatagtaggccttgtgctagatactttaacagctatctcaattgatcttcacaagtgggtgttatgatgtttattttgcagaaaataaaaataaaatcaagatctggcaattatttgtataatttgatcaattttaacaactaattcaaatagtttagatggaaaatttcatggtgtaagattattaccattcctacctattataggaaataatagtgtgaagaaatagtcctaataggattaggaaacattcatgttgagaagagattgcagagggtttgagttaatatcagaacagccagggtaaagcactgtatgtcaagcaaagttgccaacttacaatgtgaagagatgaaatggcaaaaacctgtgtttcaggtcagcgagacctagaatgcagtcctggctctaaccaggactaaccaggttagagaacctgagaagtttgattaatctttctgatccttagttccttcatctccaaaatagaaatattaataactgctttgggaacaattgtgacaactagtcatatctgtaagcatctcacagattgcctgtaacatcagatatgttaagtcaagaatgactagcatatcttttaaaaaaattacaatgttgtctctttattatgaggtaaaatacttactatgaaatgtaaaatgctgttttcatatacacttaaagccctgcatccccctctgtatagagcaaactctgtaaaggtttatgaagatttttatttaattgggtataaagcagatcttagaagagttaagcgagggcattttaaattttatttaactcagtataatcatataattttttcttaaaagattatttgttttcttgatgactactaaccgaagtaactatgattgctgcctttgtctaataatattaaatatttttaatatttaaattttaataatttcaaatattatcttttatcaagcaaaatgtacagttacatacactgtaagctcacagtatcacaaattagagactccctgcttccctttgtcacacctagtgtatcttatcatcatcattatgtcacaaaatctcctaaatatagccactgtggatgtcaaaagccttagtcctaacaaggagacatttgtttgatatttatgtgcatattttgttataattttctttatggtacagaccacatttacacaacatgtccctctctaagccactgggtttaactcattttatcaatctattgatgtccattttgctgagatagaaaattgcatgagtggatgttaagtgctctcaccataaaaatgataaccacatgaggtgatacatttgttaattaacaagatttaacaattccacagtgtatatggacttcaaaacatcattttgtttgtgataaaaacatacagtattatctgtctgttaaattttttaatattaaaaaataatgaaaagaaaaaaaaagaaaattgtaccaagtagaaaatttcaatggcttcttaaatataagcagcaatggtaaacaacacctaaataatttgtttccttatattaaaagaaaagccaactggaatataagtagattattgttttaaaaagcaaagaattattgcccaaaaataatcaagaacttcagcaaatgaaggccacctacgaaattactaattttatttaaccatataaattataattatgtagactatagtaaaagggttgttttaaaaatgtataaattagacttcaaactaaagtaaactcattctttcatttgaaaaacaaactattccacaaaacagtaaggcttaatatcttaattagcagatgcagataaaattatagttatatgaaatatctggttgcaatgtattaaatatctgttgacagtgtatttctttctttttcaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaaca

SEQ ID NO: 4843 - DNA, 72734 bp, human
tctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttgaagaaataaaaccaaatgaagaggtgaagagacatcttaatcacttgtgttgaagtttgcattttgatgcaaagtagagttgataaagcaagtaaagaaaccttcatatgatggtatcccttgcagtaattatcctcaataggacatatgtggaggtcagaaaattgccatctgtaaacaccaagtataccaatttggcaacagccagacaatgagggaagattcaaacattggagttgcaaactgagaaaaaacattcagaatgtggaagaataaataaatatgactctagtttaagattgatacattatgtcctttgcaggcctagccagctaaatgaccacaagacaaagacccttgagggaggatagacttgctttacaaattgagaattgaagaaattggtaggttatttggtatttttgttattagatagatattatttttaaacctaaaagagtaaacaggaatgaaagctaggaaacaagaaacggtgacaaaattatataactttcaacattaaaacattcacttttatacaatgatataactttttcacgtaatgcactaaaatcagagacaaaataagagagccaatgtaattacaatagatcaattccattatgtttgttaattaatgggttactgtaattttctgattttctattgaataaatattttctataggtgaaaaaacaaaaaaggaagtgcagagatttgtggtttgtgtttcctttctgaaaagagaagtacaaagctttatgtctttatatatatctttgtaatatatgtgtgtatgtatattcaccttgcccaccagcaatacctagggatgtgcgtgtatgcctctctgtctccgtctctctctctctctctctatatatatatatatacacatacacacacacacatatatacatatatatgtttgggtgatatatatatatatggtaagatatatatatgattatatatatatggtaagatatatatatgatcatatatatgtgataatatattatcatatatataataatatgtgataatatattatcatatataatatatatgataatatatatttcatatataatatatatgaaatatatattatcatatatataatagataatatatatttcatatatataatagataatatatagtatatacattatatataatatattatatatattatcatatatataatatatatataatatatatatattcctagtatgcctgtgtccttgagactggaaactatttcttcctctccaaatctgtcatgtctttcactatgactatcccctttgccttctgtgcccagtatggtaatgacattcctcacggctgtggccttggtatttgacactgccatgtgcagtcctaatctatattggggtcaggattagacaggccttgaggggacagtagtggcagaggttatctgaaatagcacatgatccaaaaactatatttgaaatacattaggcttatatttaaatataactgccagctctacccagaccaggcctgctatccacatttggtcatgagaaatttcccactttaccaagttccttagccccctgttcagaagcagttttaccttcatttcagttaactataattgaaatattcagcataatcctcaattacatatatatagagcatcacctctgcataacactgcacatcagtttattttctcagtcttttttccagtttctagagcaatggttttcatatggtagtgcacaagaacagcgcacaaaaatcaagaataatttggagattttgggacccatgatcaaaaattctgatatcgtaattccaaggaatctgtatttttaacagtattacccagatgattctcacgtagcgagagtctatacagtctacagtttgagaaacactgggctggatgaagagatttcccctttaatgccaccatgtaaattgtgaagcccattcctctgactatctctgaaactcactcaggcactcatcttgccatatccatccctttcatgttctctctccataaactcttttcataaaattgctgtttctaatattacaaataaaaggaggaaagcctctgctgtctccttcaaggtactgtgcagtctccttctttttgcagcctgactgctggagcgtgtttcctcactctcctttactatcctaaatttgaaatttcttgctactcatgttgaccatttttggttcctttttctccttagtctctgccatatttggttctgtggatcagcttctgctttgaaattctctcccttgaccagttaacactgctttctattggctcttttccttccagttactcccatccctggcttttattaaaattagccatcaagatggtctttcttccctgcccttgaattcaggagacagaaacgactccccagaatttgagatttcagtgggcagccagactaggacttttaaactgcaggagataatttagatgcatagaaagagataacgaaagtacaacaggtttgtctaacagtttatggttcaaaaatgttttaagacttagatttttagtaatttattgtaagacaaactagaaattagtttcttctttactgaccattttgtatacccaaatgggacatcaagacataccaaacccccaaataatctccaaattggtatagcagtcatagatacgaacatctaccttctggttttcttatctcaaggtggcagggcagaggaaaggaccaaataattatggaaacccctctgacgtggaacttctattttcacagtgaccaaaaagattgttcctttccaattcttccttccttggaaacccagaataaacttgctctgactgtaagtgcaaaatatatgaggaatttggcgttgttaacctagtattaagcatagtccttctcctcttttccccaatttaacgtttagtcttgaaagagagtagcatggagatggggaacaaaaatagcatatagaactaaagaaaacaatatagtcttagaatatatgaatactaagttgagctgcctttaagaggaaatttttaaaatgttcttttattaaacatgagtatgaaagatggtttggtcattcgagagcagaaatcaagtttcccaacatagatatgaggcctccatgaattttgacgggcattttattctagtccatttccttggtgtcttttttgaataattaggtaactgtattcaaatcagggtaaagtatttatgttattgaggactagagaaaggaataaagaaatttaagactgtgctcaaagattcaaaaataaagcttgtacagatgttacaataattctctaatatatggtatcttttccagctaaaatgcagccttaactatagcaaagaatagtttaccaataggaatcagctaacatgtttgattattttgacagatggccaaagactgtttctccagaattaacaatgtctaaaataaatccctcaatgatatccatcacataaatatgctacagtgataaagtcttcaagtcagtccctagtaacttttttgttggcttttctctcataaatctttcaatgagttataacaaaagtgatatgcttaataataagggtaatataatgatctatttttacttcttagatcctaaaaattatcattttagataaattacatgttcgttgggagtatatttctggaactatttctttgaaatgataactgtgtattgtgatcttaactttgatgatcattttgaaaaactaagctgctaggctgctgctttatctaacaatgcttttatcaattcagtggaaacatctagattttagaatgactgatagactatgatttttatctgtagaattttagagctgggagatcacctatcacaagacttttattttatgtatgtgaaaactgaatcccagagagagtaaataacttacccagagtcatatagttaattaatggtagagctggggctaaaattcaagtcttctgactctctgtccagttgaatacttattgaatgatgtaatcccaaagctgtgtcattttcctatgacagttttgctagattacacaaatatcacggcagttttaaggagtttataatttcattcatctaagttgcatatgctcaatagttttcctgtttagcttatatttatcacagcaataaaaatgttttcaaacaggattaaacaacgtttgtgtatataaaataaactttcaataaggtatgtgaatttccaagaatttgccaatgttcttaccactttgtgtataaattggcatctactcatgccttatataagttttgctaaaatagcaaaataggctgctagactaaaagttcaaacagtgataaaattcaagaaaccatattttgtggtgaacaatcaaggagtacccatatttaaaggtaagaaaacaatacttgaagataaatatggaagcctcataactctatcccaaaacatgttatgttttgtttcctatgatgccacatttagggttaagccacagaaaacgtcactttgtgccatgaacaggtatttagcagatgcaaagtttaacttttaaaaaattgtctaattttcttaaaatgatgctcttttaatatcatgatcttgctttgttattcatatttagtgatggtatttcttttttaagagctgttacaggttggtgcaaaagtaattacggttttgccactattctaatgccaaaaccgcagttacttttgcatcaacctataattcaaataagtaatctaaactttgtatccaacatctagtcatcattgttgcatgttaaattttctgcttgtctagttatcactcaaaagaataacatcggctgggcgcagtggctcatgcctgtaatcccagcactttggaaagctgaggcgggtggatcacgaggtcaggagttcaagaccagcctgaccaacatgaagaaaccccgtctctgctaaaaatacaaaataagctcagctactcgggaggctgaggcaggacaatcacttgaattcgggaggcagaggttgcagtgagccaagatcacgccattgcactccagcctgggcaacaagagtgaaactccgtcgcaaaaaaaaaaaaaaaaaaaaaaaaaaaaaaagaagaagaatattaaaagagtacttccattgcaaataaatgaacttatttctattttatctttctaattacatcattaatatgcctcagccttacataattgtgtgcattttacagttttatgataaataattacacgactacttaatgtccatactgcttattcttttttatgaatgagtatagtcagttcaaggagattgtgacatgtctattattttggtaaatgacatttaggttcttcccatgtaaattttaacagaacaaggcagattggaaataccacttaagatagttgaatgcagccataaaaaaggtagagttcatgtcctttgtagggacatggatgaagctggacaccatcattctcagcaaactatcacaaggacaaaaagccaaatgccacatgttttcactcataggtgggaattgaacaatgagaacacttggacacaggaaggggaacatcacacactggggactgttgtgtagggggaggggggagggataacattaggagatatacctaatgtaaatgacgagttaatgggtgcagcacaccaacatggcacatgtatacatatgtaacaaatctgcacgttgtgcacatgtaccctagaacttaaagtatatatattaaaaaaaagatagttgaatgctcacctaatttcctaagaagattaacaatttttattttacttttttgcaggatccaactggaatattctcactagataaaaccattggccttggtacttatggcagaatctatttggtaagttgacttacattatttattcattcttcattttctaatgacaacaaagattgtgagtcagacactgcaaatcacataatgccaaaatatggcatttcactttgagagagaaatcaaattagatagcccagtgacacctgtaagaattactgtttattatcacaaaagtaatggattggctaatctatagtgtaccaaccaaccaaacataacatctaaaaattagcagaaaataaagtcaccaatggaaaattgaagtaattcaaataagatatacccaaataagatatcacttgtcttatagtatacatccataccattctaaatactcacattcaactgaaaactgaatgttattaaaaggaatgttttcataacattctatatcatactgtgtacttgagtgtgcacatgtgtgataaaattttctaaagaatctaacaagaaaaaatctgaatttatttagtgattacttatggtaaacactaagtatgtgcagatgctgtgatagtctctgggaataaaatgatgaacaaagcagataaagtcccttctcttttggggcttatggttgagaaatgtatgtgagtaagtatgtatatgttatatgtgttgggtttgttgggggagccatacattacataagtaagcacacaaataactgtatacttctgtatctgtgcgttccacatccatggattcaaccaacattgtatcaaaaattaaaaaaatgcgtaatgtacagacttttgttcttgtcattattccctaaccaataaagtgtaacaactatttatatagcatttacattgaattaaatgttataagtaatctagtcatcacttaaattatactggaggatatgcgtaagttatatgcaaaaaaaaattactgtgccattatatatcagggacttgagcatgccctgattttagtgttcacgggaggccctgaaaccagtcccccacagatactgaaggatgactgtaattgcaactgtaatataagatctgtaagaaaattcttagtgatgtaaaagcataaagcaagggggcttaatttagattgaaatgtcagtgttgatctcccactccctggaaagggaaagtgaccgttaaactgatatcagaaggataaatatgaggtaaccaagaaaaggtgtggttgtggaggatgatgttaatacattctaggtggaggcatggacagtgttaagggctggtttggggatggggtgctttagtagccatatcacactgatcaggtacctttctattctctaatatggggaactgacattttctcaatcttgtgtaatgttctatataattgcagtgttctttttccccaggcctgttgctcaaaaaccggattactgtccttaggctgatccttacagcagactgatcacaggtcctccacatataggttgtatagaggtgtcctagtataagcccagaggagaaggggcttctttctagttcagaaaagggtgccttttttcttgccaagtcttgcaactttgggactacatctacccagaggggcttcttttcttattcatctgcccaggtgggaaaggagtatgctttttaaactttgcacaacagctcctatagggcctggtgctgtggctcactcctgtaatcccaatactttgagagatgaaggcaggaggattgcttgaagccagagttgagatgatcctgggcaacaaaacaagaccccagctctacaaaaaattaaaaagaaaaagttagccaggtgcagtgggtgtgcacctgtagtcttagctactcaggagtctaaggcagaaggatcacttgagcccaggtgcttgagactgcagtggattatgtttacaccactgccctccagtttgggtgacagagcaagaccttatcgcttaaaaaataaaaataataaaataataaactaaataaagcacccatagcatagaaactgagtagtagaaatagcatgtggacaggtcttaaaaacagaaagaaccttggtgaatatagggaacagagggaatgctagtattcatgaccaaatgttttcaaaccattttgatcatatctattaacagaaccaataagctatagagggtgatataatatagactgaaatatattgcttaggctacctcaattccatcctgtactgaatgattatttaatatttgtgcgatctaggtcagttttgccaccttatacatagatacctacatcttatacatagatacctacatcttatacatagacaaaatatttatggtacatttacagtctccatggctgtatgcacattttagttccttagggtgtgtgtgtaagtgtgtgtatatacttgttctgattcaaatgtatagagccaccagatgtgagaaataaaagctcagagtcatataaggtaagaagcaaggttaaaattagacaacacagaaagatggctactcattatcattcatgtgataatgaactgtgatggcaccaaaagaagaaaagtaagacggtaaaaaggtaagttatgcatgtgaatatccttttttaaaatcagggtttattgggatataatatatatttggtaagattaactcttttaagtgtacaactttatgagtttggacaaatgcatacagtcatataactgccaccacaatcaagattttcaatgtacatcttaaactaatcacagtctagattcaaggagtattctacctcttcactgtgtggtttcccaactggtgtactctagggttatggctgtcaggcattttgcttttacatatgctacaaacccacaaaactactgtactttccctatacttactcttttccctgttttcactactactatttttaaaatttagctaatcaattatcttttacagcaattaaaagtcagaaagagtcttttatgtttatcttcattttaaccatttctggaatcttcatttctttagtgtagatccaactttccctctggtgtgtacaacttaagcctgaaaaacttcctctaatatttcttatagtccaaggcttctgagtaatgaattatctgcttttgtgtgaaaagtcttaatttctccttcatttttgaaagatattcacactgtgtataaaatgtggattgagagttattatttttttctttctctcagcagtttaaacatgccaatttgtcttcagacttgcatagtttctgaagtctgctgtaattcttacctttgctcctttatattttgtctctggcttcctttaagatttttctctttgtctttgtttttcagcagtttaaatatgaaatgtctggaggtgtgtgcgtgtgtgtgtgtgtgtgtgtgttgaaaggatatttatctgagataatggttagagatctttggggttctcttagcttcctggacatgtggtttgacatatttcattatttgggagaaatttttggcctttatcttttcaaatattttttctactctatttgctttcttcttcttttggaaatccaatttcatatgtgttaggccttttgatattatccctcagttcttaaatgttctgttttggagtgtgtctgtgtgtgtttcattcttttttttctctttgtgtttcagttttgatcaattttttttctatcttcactttcattgattcctttctcagctgtttcaagtctacttatgagagagtcaaggacattcttcaactatattactgtttttcatttctagcatttctacctgactctttaatagttaacatgtgtactgaaatcccctatttgtttattcatgtttttcatatttttcactaaagcatttcatgcattaatcatagttatgttaaattctctgtctgatggattcaacatctaagtcatctctgagaggctggttatgttgattgctttgtctcttgagaatgttttttattttactttatttcacaatttttgtttaaatgacatagtatgtagaacagtagaaattaaagtaaatagtatttatttcttgaaatgggcacactttttcagctaggttgtttatatgggaattcactcaatctaataagaagataaactacatttgagttatgttgttgatatggttactctcagttcactaccagcttcagattcctctaataccttgtgcatatgtgggggttggtcttctggagagtttttcttaatatccctgttcttttctcaactttccatattccttgtgtatctgtgcttcaaagaggttcttgctccatgctgttgccctcccctaatggtatactgctattgcttcttattaagttctcattggcctggtggtgtgggcaggtagaaatgctctgtttttctgcttcaacctcagtcttgtaagatcctgggcctctgtgtcacaggagtgagactttcttagttatcctttccctcttctagtggtaggatacttctaattgtttgggcccacaactaattcttgcccttctcccaaaattggaggactttttttttttttttacctttccccagctgcagtaggtcttcatctttaccctggggagaatacactttgctgcctttcccctagggcttaagacttttattcatgaaaaggaaaggaactggacctggtttcctacctttcccactgcagtggcttctcatctccatcagatctgtaccataaatctgtatgtttgtataaatttgtcctgtgtctatggcttccaagggttctatactctcatgctaacccacatttgctctttagcagttcactaaaaatttgcatgcttgcaaccaaaatatctcatgcacctcataaatatatacacctattatgtgcccacaaaaattaaaaaacaaagaaaaatttagttgaattctttatacctgcttccgttgtgaccttgtcttccctctacagccacaggtgagctaatgctcatgtcccatctctttttgcaggtgcttgtctttctccagacctcagcctagttggttgccttgagacttctctatagattgaagaaaagttacgattagctagattattcagcttattcttgttgttagggtggatgtggcacactttccaactttcacatcctcatcaaaagcaaaaagtccatgttaattccttttaactgactcttcatgaagaatataccatatgctagatcctcctgtacacatttataaatcctaagaattttctgtgtacctactcagatccagagatagagaacaatttctaacatcagatcttccaagtacaaacttccttgttacagaaggtagatgcttaaaaaaacttcatttacaccagaatgatttccgtctgtcactcattgactttacctctttttttctacctctaattactataaaaatatttgggatggtggtgctatccactgacaataccctcatggaaaacaatctgggagtatgtaaataaacacttaaaaatgtttatcctctttacaccaataattcaacttttggaaatatatgataaacatcccagacatagacaaacatgtagatatacattgcagaagaaaagtagcatattgtggtgaaaaaagggcgtgctttgaaccaggcagacctgattcagtgcttacttagccattaactagctataaccttgagcaagtcacttaacctaagtttaagtttccttatttataaaatggggctaataatacctaccttgggaggtgctataaaatatcaaaacaatatacatatatgtacacatttgtaatatttggaatatggtaaatacctgttaaacggcagttattgccatcattattgttgctattattttttaaaagttcaattacaatagtttaaaaagatggaagtaaattactttttaaccagctaatatatcattgtcctataaagcaatatttatgaagttatctagcagcatagaactatgtttaagatcttaagtaaagtattccttattatatttgtgccccagttacagctatgttaaaatatgcagataaaaaatggtgaattaacgattagaatagtgagatattggattttttcttttctaatgtctgtaatataatatttaagtacagaacatatatatctgtacgtatatttaacatattatatatatgtgtgtattagacagtaccaaatgttgcataaataacctgtactgcaaaatagaagcatgataccattcaaaattaatgtcagagtgactcatagagtcctttgctttttcagtgctgccaaccacatcccctgctggagtttgttttggttaaagtctctccaatgtcttccagcttgtttccaaggcttcgttccctggcaggtttccagctgtctgctgaagtctgtgcacattgaaatgaaggctgagtctcacactactattgtaatcctcttcctttccttctttttcctctaattagatgcctatcctctcaccctctcccacctcctgccagttcaagcctcacttgaaattgtgggttctatttttctctctttttaggagagaaagtactggtcttctcttttttgccccagtagagttagagaatatagttttctcctcacctttaactgctagtctcatagtttatgggtcgtcattttaattggaggaatgtttagtatttgaccatgtgaggccatattagaaaaaagaaaataggttggaactcatttttaatggtactttttaaaaaaagtaatttccccaagagcaatagacacagaaagaccacagtattaagaaagagaccaagacctttagggtggcaaaattggaggtggcaacctgactctcccagtaactgacagtaaacgtgtttcttgactttctgggcccatttcttcaacaataaaacaaatgtattagactctataatctccaggctttcttctggctctgagatattgcacctagcacagtgcctggcactcagtaaaatgtaacctattcttattcttactgtcatcagcataattatagtgatcctattgtcgcttctccaccttacacagtagaagttgattattggctattagctggagtagtttcactttttaccaaataaaattatttttaacatgtttttctattcttttcttctgttttaccacctgatagtgagacctgatttttagctcagtaactaataagacactcaatgtgaatgtaaaactgggtagctggtatattgggaaggtaggaatgcttcattatatatgttatctaacaccattttgttaaggttaatactagtgaggtgagacaatgaattggtatccagaatgaatgagtttgccttggcccttcatgaggtcttgactacacccctaatatcagtcacctactcctacgttaccatttgcaggtggtgaggacagaaaaaggaatgggaaaggattcaaggcaaccatttcaagcaaaggaaaaattcacctgaaatagagtaaacttctacagttgggcatacagcctaattgccatgtacgctgatgcctagttgaaactcagttaaatgctggtggaagaaagggaccaccccaagtttcttattgttttaacacctaaaaacagaccatggccatatgtgagcatccatccttgaaagagatcacaggagtcatctgtcttcttggtggtcagtagattaagtgaggtatatgaaggtcacagtcaggagcaaattcctgaattgtttgcactctgaaagtatacaattaaatatggaaatttcgtttcaaaacaatgcatcacccttaaatttggttttataaatcaccgcctgacacattgcttttatttgcaaacctcaccagacagttgagatttatgtttattagttatattttctggatttgaagttggtgcagggaatgggaatggaaaggaaggaaaggaatgttgtcctcaaagttgatgacatacaatttatgatattttaaattacatttcagaaacacagtgctgacatttgggttgcctagccactaggcctattggatgggggtttgagtatttttccttttaggctgaaattatactgtttatttgcctaccaaatgtctagcactgtgaatgctttctttttaggtagaaaagtttccctcacatccttgccattttgcaaatatagcttaattaagtcagccaacaaataatgcttgagcaccccttaaagcacatagcactatgcatttcattatacattgcaagtttctgaagcaggagctgaagctgaagctgagttgaggccacaggcatactaggctattgtgtcttcatagtacagtgccacaagtccagagctatgtcttggttccaccttcatcctgtgacattgtgataatgtgcctcaaaagtagggattgatatttcttaaggaaccctcaagctgctctagcatagaaaacattaaatttacctattaacattgatttgaatgtgtaaaccattctgtaataaaaatttaaaaaatacatttattgaatgcacagtatgtcccaagtatcatgttacatactagttgctagttagaatgatcagaatacattttttaggagcggtcatttttattaagttagttttagtagagataaggaaggaagtattttctgtatgaccgtgaccgctttatttgaagagggagtgatgggtaatggaaaggagtgagagagattggaaaaaatgaaaagaggaaattgggacatagtttttttgtttttgttcctgtatgtagaaagtctaatgaagcttctaaagaatgagactccaagaacaagtttttcctcaataagaaaacaggttgaatatttgcaatgggggtgaaaaaaacagcataggctaaataaattgagactcaggggaccaaattagtggaaattgctgaggcttacaggccttggagaaaaatggaatatttctatcttggccgtgacaactctccaactgtggaatagaatccaggcctctgagttgcaggctttactttttcttattatgttataccaaaattttcttttgcttcccaataaatcttgagggaggatgaagcagttggtagctgacaggtatgaaaggggaaagtaaatgtcatgggatttttgctcccaagaagtcataattatttttcacaactactctaatctgcttaatatgttcacagatatatattgggaagtaattcaaattatgtatttggtgtatttgggtaacacaaaatatattatgtcatttctgcagatgcttaatccagttgattgttataaagttgttccaggagcaggaaaaataaatttaaatatttggagacaaatacacatttctaaacaaaagccaaaactaataaattctttatagcatggtggctttggtcaaccagataaaaacatcccaattatgaaaatctttatgaaatgtaagtataaatctccatggcgaaataatgcagttccttaaaaataggcatacaaaattgcctgattgctgctaagcttatatatttaatgctatttttaatatattagtcctaggaaaatttatctgtacaatattttataaaccactttatagagtgatgagggtgggttgggcagtgttagaagtaataatgtactttttaatatatcaaaaagcaaattttgttttattttgcttttgcgtatatatatgtatgtatgtgtctgtgtgtgtgtgtatatatatatatatacatagagagagagttatataattatggtcagattttcagagtaaattctgttaaggtggttgaagtatcacaagttcttgctttagtttatcgtctagtagttgaccactaaaaactagttaactaggtcctcatcacatttcatgaaacactctttggaaaatagcacttcaacagttgttactcttgaaataagaatagtcctaacttgattttaggacttccaacattctaccatacttgtgcatctgtgtctaaggtagttgtgtgggtggtgccaaaatcgcacttggagattaatgtgctgctgtagctctctgagggtgtcaaaagaaaagtggaagctcttataattttatgatgctgaggctactctgaaggcaggcttctaaaaagcagcttatcagtaagactaaattaaaatatcaaagaatataaaaagacataaacagatttttatcctgcagttttattttttcctgcttacctacacccaggttgtaataaattcctcctctaccagagcataaagagagggaaaatgaagtgggaattttgtgttatttcaattgtagaaattatgatatgacggtagtttatgtgtaatttgtgttagaaaactaagaaagctccttttgggtttgtccttcttagccagagtccctttatgactagggaaagaaggttagattgttcagggtcccctgagggaaagaagattgattatattctaagcactgccagtaacattttgtataaatcattaactctgaagagaaaacaaaacaaaaataccaccatgatctaaaaggagaagtctaagagtcctcagagaaagacagcttttcttgactctgagaaataaaataaaataaataaaattattgagtgtttgaactgggtgagaaaaagatggagatttaaatattagtcactttagagatagtgacctcaatgttctaaaaatggataacatttactgagtgcttacagctcataagagcattatgaggtagctaccattgttttcatcatcctaccatctcacaaacgagcaaacaggattcaagaacctgagttactgaataggttcacaaagctaagatattgccttgcaaagtcaggatttaaaccaaaatttgcttggcccgaggtctgtatcttaatcataatatagtatattcagctcaacagatataaaccaaagtcaaaaaacattcaattagattagccaattgaaaaaacaatctgcccaagtgcaaaaatttacaagaaactaatgagctgaggtcggtaatgaagatctttaatgatgtgtctctccaacatatttgtttccttcatgatgggcactaagacagtctagtcttagggtctttttctggaacgtaatagatttcagaaatggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccacctaagtaactttctattctgactataaaaaggtggcactgtgtagagataaatatttccaaaggatggaaatattagccttacttttttattactttctgctgaatgagtcatttaggaagcttgaaagagtatattttttctctgggtactgtagtttgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcagggactagataatattcattgtttcttttatattccctgcagtagcactgtgctgaatcaaactttgttggttaattctatattttgtagttttccttattcaaatcttatattccagggccctgatgaccagatagaggggtgaaggaatagagcctggtaagtggggaaagagagaaataggatgcaagagaccttagaactagggttgccagatttggcaaataaaaatacaggatgccaagttaaatctgattttgatgaagaacaaatacatttttaatgtaagtatgtcccaacagcatatagttatactaaaaaaagtttacttgaaattcaaatgtaaatgggcgtgttctttactttatttgccaaccttacacagaatcaactttacccccatcacagatttgccacctgacaacgtcatgttaagaaacaagaaagaaactgactctcccacctgctgtggtgtggcagagaatcccagatcagcctatctaagaagctgccaaagggtggggaggaggtggtcttctggtcccagaacagctgctactcctccctgcttcttctggcaaatgttttgtagtgctttcagagcttcataggaatgcggctttgctggcagctgtagggatcattgactccaggtgagtaattctctcctcattgaggggctgggtcaagaaaaaaagaagagttttctccttgacatgccaaggagagcctttgcctgctcagtcccctaggctgtagaagagaatcaaggtcactctgggtttattttttcctactccataagggaaagggctcagggctggtgacttgaattgattagtcactctccggttttattatacctaatataggcccaagcccctagtgtgattgcaatcaatgtcaatcaatgatattaatttttttggtgaaagaccttatgttcttctgtttcacaggccaggctatcactggctttaatctatagatttctcacagaaagaccgtttgtgtcatttagagccccattgcatgcggtccatctctgtgatttttaagttaaattactcattttatctgtggtactgagaaatttaccttaaggaaggatatgtaggacatgaatggtcagtgtgtggagtggaattgaggcagactgccggcagaactgcttaaattcaactgtcacatcaccctgctcttaattctgttaacatagcccagagaatatactgttttttttttccattttgtaaataatgttcttcgaggataaataacaatctgcaaaggaataacacttctgtagatcctaaaaagattacaaaagaggcagcaatacactgtagatctccaggtgatgtaacattgttatttatgtcctctctgaatttgctaagagtcttagtggagacagagatagagccagaaacaacgtcaccatctctcagccctcgggaacttcatttgctgtaccttctaccatcatcaactctctttctagttcttcaggaaaattagtttctcattaaaaagtgagggagactatttgctgtaatgtatagatacaaaataaataagtcttagattctagccaattacaattcaagataactttaattaagagcttattgtataccagatactattctatatgctttataggcattaagtcatttgatcctcataggaatcccatgaggtagtttttatcaatgttattctcattttgtatatgtaactgaggcatagtgaagttaaataacttgtctaaagtcatgcagtaaatgtctgagccaggtctgtaatgagatatccctggcctgtaaagccctcacttttaactgtgccatataaaactacaggagaattgttaagttttaaaaaagcagtacatttgtacatgatatactcaaatcagtgaggaactggaaggtagttccaccaagcccccaaggaacatttataatgaggatccaatgtctacaactctcccagttccagtaccattattgttttcctccagtctgtgtcaaagagactttctaatgaaaacagagagaattaatgaattatattttcagtcatttgacaaagccaaattacatggcatgttatatggggaatattagaaactacttgaaaaaataattagcaattcatgaagtgcctgttctgaatagtaaatatttaagaaagattcaattaaattttctagtagctagctttttattacagaatcagttttatgtaaaatatttcaacagcagcatgcccagtgcacaatataggttttggaaccaaccagaacaggaataaattagacatgctattgatattgtgctacacagtttcaaaagggaaagttctctcaaaaaagctagacagttgaagcatttaaaagactaatcgctttgacaagagccctgaccaggaaggtatcagtttaggttcatggaatacattctaggtcatcagctaaaaattcatgtagagacttattttcacaagtttagagtatgcagcttccatctttctataatcatgtcatactagtcccctgccatgccacagtgggagcatgtgctttggcatcacataaatctgattttaactcatggctccatgaggtgagtgaccagggagtgagttgcctaacttctgtaagccacagtttcacaaaactaatggggacaataaaacacattatgcaatgtatctcttatcatcctatgaaaaaacaggcaaaagttttttatcaatatggagaccagtattaaaatgttattagcattgcaagtggacaaattggtagatgaatatctttaatacaaagtttattttaatattcactactctgaagctgaggcagatgaggaagaatcaaactttaccacaggacagagctgataggactccattcaggtcgtaggtcaatccgttatttatagataacaaaactcaagccctgagaggggaagtgacttcctttaggtcaaataactaaagatgtagagcatccctttgctatagaaataacacgtccttctccgtccctaactcactcccactcactcaaggtttcccaggtattacctaatactctaatttccaggtagttatcctctaagtatcttacttctttctaggaatctgaaggtgaaatatctcattacttttccctctcacataagattgtgaataattaaaatggtggtaattctgattggtagtaatagctattcttattataacagtgaaactataatatttttcaaatcagaaatgattcagatgtacctacagaatcttatgaatgacagctctgagtaaatgatattattcaatttaagttaaggaggcttattgatgttcatcaaaatacaaggagaaaaatatctcataaatcagccttaagttactgcagcctctaacaaatgaaccctctatgttcagttcacatcagccccacttcacatctctttttcttatttcattttaattttacatctcacctcctcattcttgctttagattctgacaatttcagtgtggttaacaactgtgactgataggaatcttttcaatatttttggacagaatctggagatatgttaatgatttattagttgattttccagaatctgtttccaccattcttatcttcatatgctttttattattatgtaaaattttgataatttgtccctggtatattagatggtgatgaacatttgaaagcactgaatcaaatgaaagcttagccttcctgccttgccttaaaatatctctctgtattgtgccttatgcggccctgtgtattagtctgttttcatgctgctgataaagacacacccaagattgggaagaaaaagtggtttaattggacttacagttctgcatggctggggaggcatccaaatcatggtgggaggtgaaaggcacttcttgcatggtggcggcaagagaaaacgaggaagaagcaagagcagaaacctggataaacccatcagctctcatgagacttattcactatcatgagaatagcatgggaaagaccggcccccatgattcaattacctccccctgggtccctcccacaacatatgagaattctgggagatacaattcaagttgatatttgggtggagagacagccaaaccatatcatacggcccctggcccctccaaatctcatgtcctcacattataaaaccaatcatgccttcccaacagtcccgcattaacccaaaagtccgtagtcccgtattaactcaaaagtccacagtccaaaatctcatctgagacaaggcaagtcccttctgcctatgagcctgtaaaatcaaaagcaagttaattactttctagatacaaggagggtaccagaattgttgtaaatacacctgttgcaaatgggagaaattggccaaaacacaggggttacagggcccatgcaagttcaaaatccagcgggccagtcaattttaaagctccaaaatgatctcctttgactacaggtctcacattcaggtcacatgatgcaagacgtgggttcccatggtcttgggcagctccgcccctgtggctttgcagggtacatatttattacctcctgactgctttcacaggctggcattgagtgtctgcaacttttccaggtgcacggttcaagcagtcagtgaatttacaattctggggtctggaggatggtggccctcttctcatagctccactaggtgatgccccagtagggactctgtgtgggggctccaaccccacatttcccttctgcactgccctagcagaggttctccatgagggccccacccctgcggcaaacctttgcctggtgatccaggcatttccatacatcttctgaaatctaggcggaggttcccaaacctcaattcttgacttcagtgcacctgcaggctcaacactatgtggaagatgcaaaggcttggggcttgcaccctctgaagccacagcctgagctctacattggcccctttaagctatagctggagcggctgggacacaggacaccaagtctctaggctgcacacagcacagggaccctgggcccagtccacaaaaccactttttcctcctgggcctccaggcctgtgatgagaggggctgccatgaaggtctctgacatggcctggagacattttccccattgtcttggtgattagcatttggctccttgttacttatgcaaatctgcatctggcttgaatttctcctcaaaaaatgggtttttcttctctgctgcatcatcaggctgcaaattttccaaacttttgtgctctgtttcccttttaaaatggaatgtttttaacagcacccaagtcaccttttgaatgctttgctgcttagaagtttctttggccagataccctaaatcatctctctcaagttgaaagttccacaagtctctagggcaggggcaaaatgccaccagtctctttgctaaaatgtaacaggagtcacctttgctccagttcccaacaagttcctcatctctatctgagaccacctcagcctggacttcattgtccatatcactgtcagcattttgggaaaagccattcagcaagtctgtaagaagttccaaactttcccacattttcctgtctttttctgagccctccaaactgttccaacctctgcctattacccagttccaaagtcactttttgggtatcttttcagcaatgccccactctactggtaccaatttactgcaataatagtctgttttcatgctgctgattaagacatacccaagactgggaagaaaaagaggtttaattggacttggacttacagttccacatgattctggagcaaagtcagcaacattgtgagcagaggtagcagcaggcctggtcttgctgccttctgatggaacaaaacgcccttatttctgtatttctgtggttcttaagtaagggtgcacaccaaaatcttctggaggaatcatttgaaaatgcaaatgctcatgacccaccctaaaagatttggattgggaaccactgcttagttgaatttgagattctatgtgtaaactagaaatgtcagaaagggtttattacttttctcagatggtgaaaaaattacgcatatgtattgggaaggaagagattggacttaatgtggtgtgatttgcaggaaagatatctcagaccaaaaatatgttccacggaccagccttccacatttctcaaaattccaattattagagtcattcttttggacttcttattagaaatcacctgttcaagtctatattataaattaagtaatgcattaaacaactaattaatactttagcacagataagagtgggtctcaccttaatcccaagggaaatgaggcacatggcaggtaaattatttttgatgagtgtgagacagttgagaggagagttttgtaacaagggtagtggttccttaacaaagcaaagcgagatgtagcacctctgtaaaaggagagaaccctaagggcaccatgggaggggagggggttgaaggcaaggtacacttctgccagaggttatccaattgcccttgatgaagggagcctgcttttctctcttacaggatcaagtctctcttggttacaatgaccctccactgaccctggttcatttaaatgcaaagcaacaaaaggggaaaggctggagggatttaatcctaccatttaggctacatagtattaaacagctgattgatttggcccattcagtgaagagaaagcacacactgtatattcaaagcaactgttcgagtttatttgggaaaacagttaaaccatattagataaatggagaaacgactttctcaatcttttttgcaaatgccattttctgtttgctcacctgaaacttagccagagttgtggagccttctaagtcctctggtggataggagaagtgacttcgggtcaaatattatcagaacctttcaatatgttgagaatgttgaagtggtagcaagcacaggatcctagtctgaagggaggattgaggggatagggaaaatagtcatgtagatttggctgttttaagttaactgacaaatagggaaatggtgaaagttctggtcatggctataaaagaagttttggtacttgggacattagcaaccacgaattctactattccttttatctctctagatttcaataaagcccatttgtccacatatccttagagcagcatatagttaagagactgtgttcccttaaaaatgtggttttgattaatctgcctttggattatccagttgctctttggttggataacttgagccttggccttcattttttttcttttttatatttggccatctaatagagggattaaagcacatatcagatctaagcagcaggatttgaacaaagccaaatgcatgaactctctttcttagtcctccccctttaaagttagcatccattccttaaaacagtaccaatgttttcaattaaggaagccagttgaagtggcatgagtgtgcaccactttcttaaaagaagctcagaagccagaacaaaagtcttggcagataatatagtggaattaaaatctagtcactatagatttactggaaatctgctcaaacctccccaagccccctatatcttaacagtcttgatggcaaaggaggatggagtgactttttaaaaatttttgaatttcttattacactctcgtgaacttcaaatctgtcagccaagtcatgaaattagttaggttttttccacctcctctggcttaccagtttcttcctgtaaagttcagtgccatgtccctgtcgtccttggaatgactcattaatctttcttttatgaccttttggtatggttgattcacagattctactttcacatgttaattcccttagcatagtggttctcaaagtttggcctcttgactagcagtgtcagtatcacccagaaacttgttagaaatgcaaattcttgggagccactccagaaatagtaaggcagaaacaaacccaagtaggagtactggttgggggagcaggcaatctgtgttttaacagattaggtatttccgatgcatgcaccagattgaagagtcactgcctcagttatagcccatcctttgaggtgcttctttgttgcttcattgtgcatattatcctcacttagaaccaggcactaacatgagaaaatcacgttttcattggagtttcaaggtggtttggtgacattgattcctgacactgccccaccaaccatgtgtgcacacgcgcaagcacacacagacacacacacacaaatttaggaaataaaaatattaatcattacttgaatattccaggaaggggatagtgagctgcatatctctctcccactgggtgaatcccaggaaagggcaaaatttccccatgtcaggcatataagtttatatagattatccttcagattaagttcttaggatatatagatttgaggaaggtatttaagactttccttcacaatgaaaatatactgtaaactatgaaagcatgtcttcgcaaattaatataagcaaatatcctgagtcttctactcccacaccataaatccctaaaagtttagaaatacatgtagaactggttttgattatagaattaggtacttttccttgttttgcatatgtatcctgttagtgaactggaaacttaagctatttgttccttacatcttaatacacagtagagtagcattttgggggctgccttcacaaagttcctttttggcaagttggtgatggcagcttagtacaatggtttggagtactgtaacagcattctgcagtaaatttcccagtgctgatggcttagaatttgctaaatgtttctgcagaactttcagatctggaaacctgggcaagatttctcagaaagggcagaagttaaggatggtgatgtagaaagttgtaggattccctctcctgatagaatttacgtagtgagatactttgcagatgatttgaggacctttgttagtctgctgccaaacagactaactggtctcttccagccaacttggtcaatttaataataaataaaccttgtcaatccagttgtttgactaggttgtaagttaactcttggttatttaaaacactggctgattatttcactgaagacacatagcctcaagatacagcctaagtttgatatattcctattaagaaagtgaggaaatattaacatctacaagccacttgcatacaattttatatatttggtcaatggacttcagattaaacataattatttgagtcacaggaagcaaacatttataagttagtatatttcacctacatttcttttaatctgagcccaagttgactgaacccaggttcgctgtgttctggtccataatatgtcaagtggatatgtcaggtgataaatgttcttctattctttctgaggctgggtttcagtatttacaagggaatcctcagttgtaattggctccttttattcttatttgaaataaataaaacctagattaccttgggaagctgagtagtgtattaccgtaagcatgagctttggaatcgctgagacctggattttaacttttaactctgccactttgtgtgtgaccttaggcaaattacttaaactctctgagcctcaggttttctcatctattaaattaagcatgataatacttacctcacaggacatagtgcctggtacataagaaatgctcagtaaatgttagctatcctcttgcaggcaaaggacttaagttgcatttgagaatctaatcttaattaagaggcataaacatggagttgcaccagtgacctggaggaagtaccctgcttgcctttaccaggtcaatcatgagctgtgggtatagatatcacataagatgttgaacagaggggaagagagggaaagggccttaggttgcctctctgtgttctgatttaataacaagtccaaaaggattttttattcaatagaggaaacaatactaaatggtaagatggaagtacataattttaatggaagaagtaaaaactagagttaggagaaataggaaaaacttcataattgaactagaagagcataaagaaataattgtaatacaatacatactgtaagaaatcttattaaggagctacaagtgacagtgggaatgtgagagagaaagaaggagagacatattgaaattattctgattgagaagattcggggtgaggcagtttctgaaagctttatccttagggcctctcacctcctctagctgggagacaagtctgcatttgcagcatacataattgattatctcctcaggtgatggtctcataaatgattctctttatctctaatttataaaacaaaagaatgaagtgaaattattggcagtagggacctatagatatttggagacagtaatattttaaattttgctctgacactgacagaaagatgagatccactaaaccactgtagatgccatatattatgtgaaagataaagtatgtaagatatcaactcatgcttcactttttaaaaccactctaaagtaccttacattaagtgtacaacaaattttctaaataaactaaggatcagtaggatagtctctttatagttcttagacaatcaacaatagttatagttttcctgtaaggaaaataatttttaccttaccaatttcttttcaagtttgatgtttatcaaccacactcaaaaggaaaatttgtggttgtaacatttttattgcttctattgatcagtttcctgtaatcgttccttctttgattaaaaaaactcttctgacagttttgctaaatcctttaatttatattttatgaaaatatatctaaatatgttatttagttacattaacagttgcttacaacaaacttgacaaccaagacatttaagagaaagctctgtgaggaagtgcctatgtacctaacaaagaactctcattagaatctttgtccttaaaggaattctaaattttggggctgtgtttgttcttcacttttgccacttgatcttcaatggtatgtaaacagtctgtaataaagtgacactaatgctccttgaatgtcatgaaaaatctcattttagtttattatgtcatagggttagtgctcatgtatgtaagatgctaaacatctgaatatttgataacatttgaatgttatagcatcatattgttattgccaatgtgcatgctattttagaatctttatggatgcaacagcagcagaaagcaatatcaatatttagtatgcttgtaggtcattccaatttcagtaaaggagaagaacataatataccaggctaaggataccactaccacaggaccgctgactgtttagggacagaaatagggacctcaagaccacttaataaagattaaagggcctgattttcttaggtacagcagtatctaaacttctctatacatatatatgagaatgtttcgaatagatgctaatcaaatagatttgatcagtgagtgggtttttgagggtcagttaagaaagttatttgacccaacatgtagtgaaaggaagtattgtataatgttttaaaaacatgggatctggggtcagattttctggatttgtatcctgattgtgccacttaagtatctcaggcatgtgacctctcaattttttcatctgcaatgtgggcacaatgatactctttgacctatgggatagttgtgaaagttaactgagtttgtcaatgtaagaggttcctagaacctgttacataataagtcatccacaattttgcatttatatttatcactgttattagttacttgagtctaatggctctttgtcctggagtaattttgagacaataaccagcatattgaagaaatttcaattgattcattttctttcttaaacaatcattattttttattgctctattctactattaagaaaatagtattgctgtataatctctgattagaatcacactcctcttaaaatatgggctatcagttaagaagcaaaaggttggtacagatccatgttccacattactcttttagccagttacccagcaaccagatgcaaacaatttataaattaaaccccaccttttgtcagaagatttgaggcaatttgtaaagttaatatgcattgctgagatcgaggtgagagatcagaaaccaatcaggagaggaataaagataacgatcccaagaatctaagatgcgaaactgaattcagttgaataataaagatcagattttcctggcatctgaggccaaataaacaaatacccaaaacctatgatagtatttatattaatttgcagagaaccttatttcttaaagaaaaaaatccccccctttttttttgcagtcagatcttgattggttaagccaattcaaagggacccttaatttactgggggctttgttacacacatagctaatagcatgactaagaaaataaccagacaaatttaaaaagctatttccaggcatttgcagacacgtgggcacatattcagcagggtttcacaaatcttctgtgtctataatcaatagttaaaactaactctgcaaaatgtgcgcataaacaagatttccttttcatcttccttcccacttttttccttctctctctctctgtatgtgtcttctttctctctctgctgtttgtttgcttgctagtatccatcccttgcatccctggattgcccaggcctgtcacctgaggaaccctacctgattgaccaagctggctgatgtatcctactgttctcttctctatcttctctataaagcagcaaataactctagcattttagaaaacttttcagcaaaaaatagggcaaaaagtgtgttttagatgcctcttggttaagttaaacctttagtcaaatagaattttccattaactgataagtcctttaccagcacagtcagtataataagaataaagtgccatctgatgggattttctggggtagtgagactattcttcatgttgattgtggtggtgattatgtgactgcatgtgtttgtcaaaactcatagaaatgcacactaaaatgggcaaattttactgatgtaaattgtacctcagtaaacctgaccaaaaaaaatgtgtaccatctccagtttttttttttttttacttttttctattataaagggagagacttgaaagatatgtggatggatgaatggatagataaccaaaatgctatagagatagaattgtgtagttatagaaaagcactgagacttagaccccagaggtataatttcaggctcacttatactgccagctgtactctcttctcaaagtgtcaccagtaaggttactttccctttctggaatttgtttctgcctctataaactgaaagcattgcactagtatctgattaagctcaggcaattcctctggtgaggtggcctgatttgggggaagggtaggagggggaagtaggcagatttgcttgagtgtcagaaaataaatcatctatcacaaaaacaggtggaatggataatgtcatgtgaaatttgagaaacatctgttcgcctatattagtgtctgggtcaagatggagccacctgggttgaagtgatgtatcaggttgccaaaatcagtgtctagttgacccaagatgatttggccagtgtaaaacaagactgttatcagttttacagtttttagggttttttcactttctttaatttctggggaattgttattttttggagctagctggggaagagggaaagttaattaataaagttaatctcagtgtaagagaatatactcaccttaaaagagtaaagattgccttctaagaagagtaggtattattttctaaatattttactgtcttgctttactgtaattgcttgctcaaatagatctctttcagttagataaaagagaaaaaacctggatcattgattgcataaatacagaatggggaagagtaatttgtttagtaatattgatatgtgctttataacataacctgattatgtttgggggagctgaatttccacttccaagcacaaacagacctatatagaatagtaaaattgctaagatgatgattttgaaagagaaataataagagccaaggtaaaccatgttctatgatggaccttggttgttttcatcctgcaaggagcatcaataaatgaaacctgccagataaggttctccagtgataaactagactactcttatgccaatgacttgccaaattattgtatatagccagtatctgcatgattttatgattcataacccaaaaagggtgtgtttaacataatatgctgcttgaacctagaaatcagcagcagctgagaaatctacatttcagaaatacactggaatatgttcctcaacagagtgtgtggaagccaggcttttaatatattaatacaatgcttttggaaaatatatcacagctatccccagtgagagatgactgctttttagtgttcacttaatagccacacataaatagaattctttgcactaccttatgcaatgcctcctcaatcacatgtgtattggggcagggagagaaaggggtgcagaagccttttgaggaggcagatgtgcagttggggtctcttgccatacagaaagcttgaaaagaataataaaaccagtcaatggtaattttgtaatagcttagatgaccctgaaccccttgaaggtgaagtccttgacttaatttgtttttgaagctctcacccagtaccttgccttaaatgaagtatctctgtttggctttgtatttttttattgcttgctatgtgtcgggcactatgctacttctttcttgtaggttatctgttctaatctctaaaacaatcctgtgagggaaggtatcattattccccttttacagttgagaggtcaagtaacttgccttatagtcacagagttagctaatgataaacagctggaattcaaagacaaaaatgcttttttaccataccagagcttgcttcagtgtccagagattgaccatgcattaatttgtacctttaatatatgagtattattattaaaatgtatcttttcaaaaaattttttaagactagaggaaattcatatttaacatctccacagtcattatttaacttattttcatttaaaaataacagctttattaagatatcatttatataaccatcaccttttaaagtatacagctcagtagtttttagtgtatacaaaaacagtgcaaccatgataactatttgattccagaacattttcattacccacaaaggaaaccctctaaccattagcagtcatcccccaggccccctgcccccagccactggcaaccattaatttattctatggcatattctggacatttcacataaatggaatcatacaatgtgtgacattttatgacaaactactttctcttaacatatattaggttggtgcaaaagtaattgccattacttttattggcaaaaactgcaattacttttgcaccaacctaatagttttcagtttattcatgtcgtagtatgaatcaggacattattttttcttatagctaaataatattccattgttattgatataccacattttgcttatccattcattcatcagttttgatggacatttaggttgtttcagcttttgtggctattattaataatgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaacaactaataatgctgaacatctcagttgcttattgggcatttatgtcttccttggataaatccattcagatcatttgtcagtagaaatccctgataagatatatgatttaaaaatattttctcccactctgtgggttgtcttttcactttaattttgatgatgtccagtttatctgttttctttggttatttgggcctttaatatcatatataagaaatcattacctaatccaatgtcacaaagatttactgctatgttttcttttaggagttttatagctttacgtcttacagttaggtagctgatccattttgaggtaatttccgtgtgtggtagaagggaggggcacactttattttgttttgcagtttgccccagctccatttgttaaaagacttaatctttatccattgaattgtcttgacattcttgttaaagattaattgcccataaatataaatgtaagggtttatttaatatattttcatcaaattatgaaaggttaatattgttaattgtgcttaccatgaatttgatttaaatttttgaatttcagctgggcacggtggctcatgcctgtaatcccagcactttgggaggccaaggcgggcagatcatgaggtcaggagtttgagaccagcctgaccaacatgataaaaccccatctctaccaaaaatacaaaaaaaaaaattagccgggcgtggtggcacgcgcctgtaatcccagctaatcaggaggctgagacgggagaatcacttgaacctgggaggcagaggttgcagtgagccgagattgcgccactgcactccagcctgtgcggcacagcaagactcttatctatctatctattgatctatctatctatctatctatctatctatttatctatatctgagtttcacataaaacaagatggtgataagatacaaattgtgcttagttgctgtaaaacagttattgaaataattttgtcatcaaggaagcaacagtgaatggtttattactttgaaaataaatataattgagtctttatcataataaattagtattctctactacagcctaactttaactgtgaactagattactcaagagctagttttgaataaggtaatatataaatgtcatcattcattggctgccttagatgaaatctaagaatttttttacttgttagccactaaaatttccaatgagaaaaaaaaaagccagccaggaagttatcctacacaaattaaagctaatcataagacattttgaaaaataaaaataataggaaagtcatcatccatttccaaaatgaagaaatacattttcaggtctctgaagttctttcttcctcatgattttattttggttgagattatccagagatttccttcaaataatagcaatggacaacaaaatattttggtactatgatatggaccatttgatgtacaaactatatagagaatatattggttttgaaatgggtgtgtttgtgactttaactttccaaagtcaatatttaccatggatgcaattagtggctgatgttaaaactaaggtgacggggcttgtgcttattgtgctcttaatggtctcagcaagttgattaaatttgtttccagtgggcaatacacttgaggcaaagaggccctgcatagagtttagcaaatttatactttaacaattcttaaatattccatatcatgagtggctggtttgagaattaagattttagtcactaaaaagttagaaagtagcaagagaagttatgtactatttatcttctagacaggcctgagagaaacaaaaaacaatattgtataaatggtggacaaggaataatacttaagctgtgggatggtatggtatatgatttttatgaaacctcagcccaggcttttgcaccaaattgattgcattttctgaaacgcaagaagtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttctctcagcttaacaacactaatgcctgcaaactttcctagaaagattcattttccattactttaatcatttctgttattctctgtagaagagtattcttctcttttaaaggtaataatgctcagattgacttaagtggagtttcttcaggagattttgcactttttatacattttgtataagagaaggagcctgacaatctcagaattctatctaagagacttccatttcttacactgacatttctcagactgtcatttcccatcatcttatgtggtaatttatgaaaattctataagcaaggcttatgccaaagcagttcccaaaggcttttgctgttggagtcagtttggccatcaactcatgggaatgacttgtttaagtcactttttgtaagaggataatcttccaagctttatcttatccaaagcaattcagttgcatgaaaataataaaaagttgtaattcagatggagacataaaaatttgatttaaaagacctttttctattgctatgactttatttggaatgtataatgcagagatatgctgagtttaactcatataatgagaggcagagtgtacacttgtaaatcttcatagaaaggatttcacagctctcagtgctgcttagtatcaaaaatctaaatgagataccaactaaacacagatatttggcctgcaatattgtatagtacatctagttaccctgaaaacatagggagaggtcttgagatatctgtgggctacttcactattacaacttgccaattctgtaaatggactcactctatttattaggaaaatctctccctcttgtttgagctggaaatttctaaatcttttaaaataaaaaaaattaatgaacaaactctgaaataatcaaatgcaccaagtagaggaagaaatcagatctttccagaaaatcactgtttgttttaactggtagcaaagatggatcaaattgtaaagttaaattaatatatacatcttaagtaaaacacatacacatacacacacacacacagacacgcacacatatgtatggttctcaatacttgaataattttatgatttaatttggtgattaaacttgtcaggagagaaaaactagtttccctttggctttctgtaaggcaagacttggtcatgtcccagttaatttgggagaatataactaggtaatttagggtgtctgaattttgcagagacaataggtaaacttcacagagtttaggcaaaaaggattaatcagatgaattttcaggggaataaacttttctcttctctctcctctcccttctctccccttttctctttttatcccaccccaacagtttgggctggaagcagcttacagcaaatcagcaccttagcactcttaatatcacccagtgaaaagcagggttctattcttctagccatatacacaactctttatgccccccttcaggctcctgttggggattgtattttcccttcactattgcctttgatgtttattttaaactgtgaatctctcctgcatttaaatacttgttgcaccccttagcagctgctgaaacgtattgcaggggttccactctgatgagacaattataaaacaatctcactatctcctaagcccgcacctggggtggtgggttggggatagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagcaaaaaaaaaaaaaacataaaagtcagtacacttttttcatggatcggttttaatctctgttatgaattctcaaataagtgttttttcttaccttaaatttatttttattagtgatagaggaggtttatttcataaatgaaattaaaaatctattagaatatcagaacttctgtgcatatatgcctaaaatataccctaaaactaagtgaagctaaattgatagaattacaaaagacattgatacttccataatcacagactggaggactttaacatctgcctcggaatgttatagatcaagttggcaaaaacctccataagaatgcaattagcaagcttggacccatggaaatatattgaattctgaatcaagagttagagaataaactaaaaaataatcaaggttagaaaataaaatgtttcttatgtgctgtattcttttccagcacgtaagggacattttgaaaaattgattataatcttggctgtagagaaaatcttaaataccaaagaatccgtatcctatagaacatattctctgaccaaaattcaatacaatttagaaaggaacaacaaaatgataaccaaaaatccttaagtgtttagaagttgaacacatacatgtctgagtgatttataggaaaaggaaaatgttaatgtgaactcaaaaaatgtatttactttattggatatttatctaatgcattaatacttttgattaaagaggaaaatagtttttggggcctctcacacatatcaaatgataagattaaacaaatagcataataattcataaatatttgtgggggctttttaaaaagtgttgttgagcaaattaatataatagacaaaattgtaaaaagattatttaatctatttaggacaacatttttttttcaagttctttggtagccctagattttctatcacacacttcctaacacagtgtgttgcagacaggcattcagtgaatttttgttgaattggttgcagtagaggatagtgaaaacatataccttggtatagtcttgatgagttaattaaaaattattcttgctcaatcaatatactaggttctctaaggttctctgttaggcagcctggatgaatatattgaagttgcttcaatttagattttaaattaattcagattgaccttcctgataatactgctaaataaacgaagcataacgtaattggttaatcttttcaaaaagacaaagtaaatctcaaagccacatcccacagatactctcttgcctcggtcagatgtgggtgaagtatcttctctggactctataatctgtcatctaagccagatggggatacatggtttttgaaactgattagccagggtgaacttgctaaggttatagatagaccatctaaatttacttctaattccagactaagaattaggtcccagttcctgacttatacaagcccaaagtgaaaataaatttcatcaaacatatttttatcttttaataagtttgagcattgtccgagtaacacataaatggttaaaataatatttagactgcatttgtgcctgcatttgaattcacagagatatttataggtgaagctctctcttcccttttgcataaacattaaaataattcaatcagcttgttataccagatattttcgttatatctcccaaatattagcagtttgttccataggatttaatcatggttccatccagaggcttattattatagcagtaatttatggcaatgaaatcaatttgaaaacatacagaacctaagaactaacaaaatgtagttgttatgtgtgaattaaaatataaactgagaatttgaaaatattcaaataactagaatctctctaatttggtagactgctgacctggatttgtgaaacattttcaataggaaaatcttaaatatcattctaatactttcaaagaccttgtaattttcacttgtactcttactgtgaaaattgccacattgtctcttgcattgtggaggtttgtgtaactttattatctatattaaaaattccttaaaaataaaaactataactaatttttatatttccttgctttctacatatcatataggtagtatttaataaatacttacatatgcaggtagtgtgaaagggttaaagagcaccagggtcttgggcttagtcttgcctctgctactacctctatgcctttggacagtgggaatcaatgaatttggaaaattagtggtggagaattcagcagaaaaaaatggtgaaactatttgaaggaggaaagaaaaaagtcaaagttgtgagcaaggtaaagttggtttctacgtgcttccatgatcctttagatcgctttccttcctttcctccaaatctgggaattgtcattgctacacatacacactgctccctccacgtactcctcctacatgcatgcatacacatatacacacatttattgaaacaaccagataattgttataaatatgtagttttatctagacgattgccttagtcttccatattgcctcgctagatttcacttgcctacctcagtgacttttatgtttgggtagccttaactcaaatcttcctgtagttggattctattattctgtgcaatagtaccattctacttttatcatgttgcatttttcagcttggcattctttgagtggctatatccaccatactttccccccatccacttcccccgccccccaccactctgttcgccacacaactgtaagggatatattgaggggtttaactctgagactttcagttgatttcacactcttcatatttcatttctgcaggctttaggtaaacagcatgtcataggcaaatccagcattatagtagccaaaatgttctgaaattccgactgccttggtaattccttagagttaaaaaacactctcaaaaaagcattaaatttaaaaactcaagttcgtaattaaaaaaaacacacacacacacagccccagttaaaatgcacatgttgtaccatgatgagaaaagaggtcactggataagatctttgcaatacattagtatgggaagattagctagtgctttggctttgcaaaggccaaagccagatgctgaaggaatgggacagcagggtggaatgttgaggaagggaatgtgtgaggcatggagtttacccataaaggtcaattcaaggcaacagtctacatgtaaaagtagttttcagtcaacttaggggctacaatgaggactcataccttttgagggtggcagggcctggaagttagaggtaaattgatattgatagaagatgtccttttgttctctcatgtctatgtttaaaagcattgactagaccctaagggccttgtactatcttaaatgtaaactatgcttttttcctcatcatcatctttctccagtctttttctactccctgctgcttctctcattttctcttctattctttccttttctattttccctcctccttggcatttcccttattcttagtagccatcccagtcaacttcagtgcttctaaagtgcctttgagtactactagttactgctatggtttgcagagacaattcagtttataaagactttttaaaaaatgcatcaacatcctcttcacctcatctttatattaagggctgttgtgtttgtacctctgtggacacacctggaaaagttgagaattccattttgactgtgtagattttaagacaaagttgcttcttttggttgaacccctcttctcagtcatcacccatctgtctcagtgcttttctttcaactagttgtgctgtttgatagaattggaaacactgcagcttacatctgtctgagcagatggaatgcattttgcatgagtgttaactgattcatgcattacataaagaaagcaatctgtgttaaaacattgtgacattgcaataaagcactatctgctgtatgctgaaacctgtttgcttacggagggttttgttgctcttgccataccctcacccactgccccatggttaagcccagacaaaccttaaaaggaaaaggtatacaatctaccatagtgggagaaaatagtaactgaaagaaaaaaaatcctgaatatgtaagtcattccaatagatgagttcttttttatttttgtagtgtattgtcattcggagggaaaaaaagagaatgtcattgtggggaagcttcttacatggagaactaaatagtcatcaatcacttgatcatgctttccatatactttggtaaacaatgctgcttggaagtgttatcagagggtttgaaatagtgtgggccctagtctcatggagttcctatgtagtttcctcagcatgtgcagttatagcctgtgactttaaatttgaattagtgaccagcattgaaggttttatggtgtcacccatttgtaacagcaagcttcaatggctttgtacttttgtcccctgtagatctggcttgccacatagcagtatgttgcagtctttccttagttgcctactagtagctattcatttatttcctgcaaatgttgtatgtatcccacagccaagaacacagaactttattgtccattttgtacaattcgtcatttgagtgctatagcgtaatagagagcagctctatgtgcaaatgatgttactatgtattttgacctattgtttccctgcaggagtaataacaagggcaataaaactcagtcaaagctgctgtataagcacacataactgcctcaaattacagggcactttcaaagctacaaagccactgaaactacgaaggctgtcttctgactcctttcacagttctaataagcatgaccatgactgtcccagatttctggaaggggaaaaacattattctgttggattattctggtgattctgtagctttttagctacaaaaatctgtttccatacaaatcctttgactacatgtagcaaaggtttgggtaatttaggggtatgttaagaaaaaaaaatgtagaagtaaagaacttagagctagctctcactatcacatgtccccatagttgatataactacagagggtatcaactgcaagtatttagtgaagatttcagagtagtagccacaggttaggggaagcatggatgaacattaagtaatgttacctgacaaacttttgtcaatttggcaagagccttggcacttcgattattttgtgagctcatgccctctgaccgtgactagcttcttcattgaggccctctgactgaatagagttgtgaaaaattttgggtggcatcacagtgcaacctagggtcaatgaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatcttaaagtgtcaaggttaaaatagtatttattcaactccaggatccatctgctgaaagtcagaaatatcgactcctgccagttctgagttttctccaaaaggaaaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaatttaagtctcaggtgaccaagacactgacaattcataactcttctttacaattattgggtaacctgtatttgattctgggtccccagtgtaaaaattgaccttgcttcattacttttgagatacaactaaatttggggaatttggtgtcgcatgaatgcaagtccttttgtaaagtagaaatgttttatgactgttcctttatttgctttgttatgtttaacaagattttcctgcattggtttttgttaaaagcaggcacatatacctcttaacaatgccctgtatgtgagcagtatcttaaattcagggacatgcaacatattcttttcgtaggacagatttgaaatgctaatattaattttagagtcatgaagaacaacagcaccgtaataaactaggtttttcccaggggaagtggactaaatgatgctgcttatttgattatctaagttaattaattaagaacacaaatccttgccaaactgaaatcaacacattaagggatatgtattctccctggatagtttgaaatgatactgcaaaaagaatatacgttcatcttaattactatattttggaatgcaaccccagaaaacagatttagttgtgtcagcataaattaatcagggaagttttttaggactttatttaagtccttcacatggtagcatatattttttctctagaactgtttaaacatactgtatttgagatccaataatttatgttaataactagcctttgcatttggttctattctctaattgtttctggtgtatacatcttacaaactataaatttctccaataaactgtgaatagaacagtttatctttccaactctccatcctcttcccctttttaaaacttcattcactttttgaaattccctgctcactcatggtctcatggtttccctgctctccattccagaaacctgcttctttcaatatggctgaagaacaaccccttctggaactcctcaggctccagccttttctttactccaccttctcattccatcagtacttaactgttcattgccactgttttagttacctcatctgatagtctaactcatgcttaaatgttagtgacaaattaatgtgtccttctcttagctaatattgagtttcattatcttaataacatggaggacaggacttaataaataatttttataccttgttgtaggttgtggagtacccggaagtattttgaatagttgacctattgccccccaaatcaataactgaattattatttattattattattattattaactaaacttgaatgcgtggaatgagtttgacaacaagacaaagagttttcttaagtgaagatgatagacttcttgattctaaatgccaatagacttgaatctagagtcaagaatgactacaaagcattgttactacctattgtcttctgttcctcaaatacgaaagagcctatgaacttatacaaagtatttaagcagcagttgcttttacgataagaatgagagctaagagaatttttttctcctagctctgtgatgcttgaaaattatttaaaaagaaagaaatgctgtcatttgtgacaacatggaagaacctggaagacattatgttaagtaagataagacagacatagaaagacaaataatggatgatctcacatatctggattctaaaaagttgaactcatagaagcagagagtataatagtggttaccagaggttggtggcagtgggggacaggggattggggagatattggtcaaaagacacaaaatttcagttagacagaagaataagttcaagagatctgttgcacatcatggtgattatagttaataacaatatattgttataaatatatttactaaaagagtaaattttaagtgttttcaccacagaaaaataataagcatgcagtgtaatgcatatgttaattagctcaatttagccattccacaatgtattcatatatcaaaccaccttgttataaaccataaatatatacaatttttatttatcaattaaaaatgtaaaggtcattctttgtactcaaactctagttaatgaagcattattaatcttgtggagctagtggctcctgtatgatactccagatattactgataggaaaaacagcccaaaaaatccacatttataatttactactgttcttgtgattttcctgaataatattcactgaggttaaaggcaattgtgagattatttaacactcaatgtagaatctaaaactaaatttctttcttaacgttctaaaactaaattcctttcttagtgttcttttgtgtgtttaacacaaatgttgttaacgtaatttgccataaaactcacattctaactgaaaaagggcacatcctaaaaactggattcataggttctagttcagcatctcatttatgacaagtccttcagctaagatcgcaaaacagcttctgtataatcaatgaaccacaagatggcaccactgaacaattagcttatctcaaggtggcttctaggttctctagataggtgcccaagaatagtgttatacttcttcaaaacgaacatcagtcacttaatcagtcacttctggtgaatagagtatgaaagggaaaaataacaactttatagtggagaaacctggcaggttgttaccttaaccaagtgctcaaggttaatatcaccattgatcaacatggagatatcatgtacccctgatatgatgtgatgaaaagggcatttcacttctgtgatatccttcccaaaaattcacataacctcaatctaatcataagaaaacatcagccaaacccaagttgagggatattctacaaaatacttgaccagtactctttaaaagtgtcacagttatgaaaaacaggaaagactgaggacttgtcacacactggagaagtttaagaagacatgatagctaaatagaatgtaggatccaggtttggttctagaaaaaggacattagtgagaaaactgggaagtcagaataagttttaaaatttagttaagagtattataccaatattaatttcttcattttgacaattgtagcatggccatctaagatgttaacattggaagaaactggggaaaggatatacaggaaccccctgtgctatctttgaaactgctctataagtctaaaattatttcaaaataaaatttttgaggagtcaaggtacagggggaactcttctgaaatgctctcttaacagtagcacatttctatgatctattgtctgtatatgccagacttctatggagtcttgtagaatgatttggcatattaactcagtacatggttccgagacctggagttttattcctctgtaggttcagtgagcatatttttcaaacccaatattaggacacattttctgacgaaataacttcattcaattttcaagtgtgaataaatcacagataatgagggtagaaccaagctgattttttttctgttttatggccatggttggaatcttttaatgacattcagttgtctcactaatatgtcataatctattgattttagacttcaaaaattttgtattttacttatcatcagttaaataatgtatggctaatatttttgataacctgataaatattttgtattgcccaaaataatagtggctcataaataatctcttagaatcaaggaaggaagcattgtaactttttaaagggatgcatgcaaatcagtttccaacatgttgtatttgtgcatacagatgtggaaaaaattttactagcaagtgttcgtgtgaataattatgaaaacaatgcttcctaagttataaggactgaataaataaaaatattaatatataattcctcccagagatgtaaataaatttgaagggtatccaacatactcaataatttttataaactcggttaagttcaggtgtcattacaatcctacgaaaaagaacagtttaaaactgttttattataactgtccagcaaaagtaatctgactccatccaaacaggctgccccaattaagacaagtgacagaagataacacaagctcatgttcttttgaaaaatttaaaagaagctaaggaggttgcaaaaatagtgctttttgtctgataaaagagaaaattgtttctagaacttgatagtattacttcatggattgatccttacaaactctgcctcatttccacttctcatgtaaatctgattttgcctttgcatttgtttcccaagactttaggttaaacagacaggtcttgatcttgggttcctacttttctctggatcaatcaataacctgtaactttttcctttcctttaaaaattctagtcttctgtggctggcatgctccgccctaaactgctcacccaattctggacatttccttgtgccttgattactagtctctgaaccctatcccaagtcaagcacattaccttgctcagtttccgtctttcctgccttgtgtactagtttcttaggtcagctgtaaaaaattgctacaaactggatggcttaaaacaaacaaaatgtattccctcacaattttggacataagaattctgagttgaggtgtctgttgggccattctctctctgaagtctctagggaggaaactgttccttgtctcttcctggcttctggtgttatcaacaatccttgacatttcttggcttgtagttgtatcactgcaatttcttcttgtcttttacatgactgtcacccctttctgtatccctgtgtctctgcgttcaaatctcccttcctttcgtcttataaagaaaccggacattgaccaaacaaatccatatgacctcatcatagtttgattacatctgcaaagaccctgtttccaaataaggtcacattttgaggttccaggtgaacctcaattttcgaggggacactgttcaaccaagtacagcccccagatcaaaccttctgctgagaaatatcagataaggcattctatttattactcatagtaatgttatactgattttttctatgactacagtttggaatatgtctagaaggtaccagccacaaaataggagatctgattccaaacctatgtgttcacctttaaaaattacaaatctgtagcttatacttgcatttagggtaagatctaagctcttataactcatcatattttcaataagagagaattttctagaacttattccttttataaatatttttggttcatatgattcaggacatattaaacagtttagaggctgttgaattaattatgaatcactcacactaagtgatcattatggagataatgcatggctaatatttttgctaacatgataaatattttgtgtttgaagaagagtccagtggaaagatgtctgcatagtatcacataatcaattgaaaaaatgtttagtacaacaactcgttttctgccatcttcaatagaaaattttcacttagattaaatgaaaattttcatttagattaaatgctttggtgccatgcaaacctagattaaagacactaagtaagcaataactttaaataggcaattatgtccactagttactacagatgtaaacagccaaactgttccataaccttcgtcgagtgttttgagtgggatggtgatttctttaaaatgttgataatttaatatttctgttttctatataatactatatatttcatttgtatatattttatattttataacatacaatgtattcgacactaattttaatattttctactttaattgcttcttgatagctggattacctagccagcatttgatatttatcactatcctgtatttcagggacttcatgagaagactggtgcatttacagctgttaaagtgatgaacgctcgtaaggtaatattataaattgcctgtattctcttcccttagtggactgtgttcctgggatacacaactcagaaaatattgtatttgtttttaaatcattattttatataataattattacatcaatctggatttattatagttatcatttaatattacttttattcattagtgtattatatctattactttattatatatccacataaaacaatgcttctttcacagcagaagttccacatattttggtattctataacactgaggaatatatctgtactcctctctgtttctagttgactatttgtttccagggatagcaaagaagagattgcttctaatattgggttaatcctgctgtgttccatcatattattttccctctccaatgatttcctctgataattgaggccattagattctcaatgacaggtagaaggaagagacttatcagaaatgcacatttttcatgtattttctgacagatgagcaaaagagacagtttaattggcaccgttcctggtaacattcataaagttgtgtcacggttcataacatattggcatagaatttgctagcactgatttctgttctttttctttaacgtgagtgccacactttctcaagataatattatcataaacatagaaaaggtcaaaaaaattttacttcactataccctaaagggaaatttgtgtttgaaaagctatacacattgactgaactgttgtcaaggccataaactgtgctttttccaatttgtgcaggaagtgaattgctgaaactgtttaaagagttgtgtgcttccatagcacatgtgtacctatgtaacaaatctgcacattctgcacatgtatcccagaacttaaagtataataataaaaaaagaaatgatagctgaattaaaaaaaaaagttgtgtgcttttagttttgccagtaaatgtcaaaagttgcaaaccaatgtgagtttcgagggattttgatgttttgtagatttattttgccctacaatccatggcttccaaataatcaaacttctactttttgagtgatactctctaaaatacttattttcttgttttaacttaagagaccttgacatacttttaacctacatttcagatactctgacttttaaaatatttaaaaatcatgttcaacccatggaagtttagtgtcaattaactggttttgtaaggaggataaagcactttactaataacaaattgtaattttcccattattacagcagttaaatctactaccatgaatttgttgccaaatttctgtatgtcataagaatttggttttttaaattaaaactattggagaaaattgagagaggaataatgttatcttacttttccattgagtgctaacgtagcttaaagtacttaagcataaatcatttttagagtgtaccagtacatctaataacattttattcttggttacagacccctttacctgaaataggaaggcgagtgagagtgaataaatatcaaaaatctgttgggtggagatacagtgtgagtactaaaagttctcattaatacccaagtagtctttcctttcattttcagcttttaacttatccctttgcattgtgtcattatctctagaagactgctactaaaagtgttcttgcctgaaagtgataacatatttatatcttttaatatattcacttagattcaatcatcatatatgagcactagcatatatcagagagtaggagataggagaaaagggcccttgaataggaatgcattgactgtcagtgaggaattgcgtaaatttacagagcatagaaccctctggctgaatagcaacaaaaaaggaggtgatgcgatctacagcaaattttgcctaaaattggccttggaaaggtccttttcacacgtttatcatgacattctggactaattgcttttcctccattgtgattctaacaaacattaccatcgtgtttgaaccaaatgaggaatgccccacgtgcccacccccccgctttttgtaagagcaatagcaggcagaaaacaaaccaaccacttagcctcaaggtcttcagacatctggtaccatacttgaacacatgaaaggatatgaacatgttttctatgtgcagctttttggcttaccttcagagcagtttttctgataccaacaattctctggctccagaataaaaccaaccaaagataatctctctttttcagtagatattggtgatctataaaatattgtatgggcccaaaagttgaatttttgctcttatcaatataatgaattgatatattttttcctacttttctctcctgcagtcagctatacatgagactcaaatatttctagcattttgtgacttagtaaatatgtctcaggcacattaaaaataacccttttactaacacaatcacattcagaaactttctagttatattagaaagatattactaaacaacctcatgactcatctattaagtactaggctcctgttatgtctataattcatgttaggagactaagcatatccagaggaccagctaaaacagatagtatcatgcttttgtagcttaggaaaccgcaaaagataaggtatggaaaatatgattattttattaattttggtttcatcaaacatttgtgctaataaaacttttttaaagacctgtcccaaaccctctctggcacactttccttagagaaaaggattttgattctagaattggatgaaattacaaaggaagttctggcatccttgagctgcctcctcttgacaaaacgcagggtattcaggccagtctgtgatcaactggccctaagccaggaaatgctgtagcatcatattactggaagatgtgtgagagttttaaattacccacttggtctgatggatataatgtacttatgtgtttctcacaagctcagcttcctgttaattcagagtggcaaacacactaacgcttcccaaacatatctgatcttcatttatttgttttgggggagtttacatttatgtgggcaacccactcttaaaaggtttttctagttggggactttgaattatctgattatgtattttagtaagaaaaaataactgctagctaatcatccagttagtatctctaaattatcttgaatcctttaggataaaaagtatgtgacttgcacacacatctcttagatgccaggggtttatggaaatagcaataatatgtaagtccagaaacatgagttcaaatcccaagtctaccactaaatagccaaaaagtgcttgggaaagtggtttacctttctatgtctcaggttcctcatagaaaaagagacatcacaaatgcaactacatagctgcccagagcccagcgcatctcttgttctttccaggacacataagctttctaactcaaaaagaaaaggaatcaccttaacatcaagctaccaaactagtgaaataattcagtcttgcccctgcttctctttcacttgttctttgtattcttaacctcctaccatcctctcattcctatttattgcactacttatgagttcatattcctctcagcagaaccttggcaacttaattgaaactgagagtgcgtacgcacaaatattctataatagctagtccctgtggtttgctagtcttatgcggtgccaggtattgttactatttcaaaggagggccacatcacaggggaagcagaaagtttaaggatcttacatgacaagaattaaagccacaggatttttacctttctagaaaacagattaagataatttgaagggaacttattaactgaactttgctgggaggttgggatgagactctagcctgagctttcatgcaattctcataccacaagttgtcatgactttattacacaaataaatagaaagagggaacctatcactgagattttcaactgcacatatcaggacctatccttttcccccataagacaaataggtgtctagagatttattttccagtagttgaatgtttataggtaaatccagtggaaaatccttgggaaatactaaagaatgttctgcaactgccagccattttctctgacattgcaaactttttttttttttacgagatataaataccgggcattttaggggaggaaagataatttataactaaaagttaagtcaacttagagacactacagagcctagtgcactgctttatatttatgtcataagtatttttaaagcctagccacattatacctaaatatagaaagtagttgcctatttttcctgctggttcttagagaattagctaagagagaaggtaataactgagttatgtttagttaccaattcatttcagctaagagacttatttccctatatttcagtcattaagtcaggatagtttgaggaaaatgctggggagaactaaagaaaattggtggttaatcccttaattattttccatgtcaattgtccctttcctaggtcattgctcaaaagagttaaggaaatcttttttttcactggatttcagaaccggaagtctttaattcaaaagttttttgtttgtttgtttgtttgtttttgagacaaggtctcactctgttgcccaggctagtgtgcagtggcacaatcttggcctcctgggttcaagtggttctcctgcctcagcctccccagtagttgggattataggcatctaccatcatgcttggctaatttttgtacttttagtagagatggggttccaccattttggccaggctggtctcaaactcctgacctcaagtgatccacctgccttagcctcccagagtgctggaattacaggtgtgagccaccacgccaggccaaaagtcttcttttctttacactctacaaatatatttcactttcaacaataagaatatttcttaataatttttataaattgaactattatagatgaaataggagagctttttaatttacaatcaaataaaatttagagctactatgaattcaaaggaggtcagtgaggaatccatttttcaagtacagaatcacttcctgagtcatctcacatcaccttcaactttattatgtattcaactattttgtattcaccgttggttgtgtcattcacatatgtgaatcttatttcctgatgtgtaatttcctttaagttaggatcataatacctaaatgcacaaaccaattatattttcattgaaaattttaacaatttaagttgtctttttgtaagttaacattttaagatatttttctcaagtgtattgcatctgtatacacaaaagtgtaattgttttcaaattattaagaagcaaagagttttttctagattggctgagaaataagagttacagaaggaatatcaaaaccacttggctatcatggtacaagcagacatcactgaaactttgagagaattgctttccatgtcactccactataattaatatgctgggaatgaaggaggctgatgtttgtagattacggtaaacagtggagggaagtgtatagttctgatagcgctcggagtaattcaaagaagtcaaataacaatgatattttgtgataatacattgcatttatagaatttttttcaaagatttcaaagaactttatatatgttatcccatttggtcccactaacattccatgaagataggtaatggctgctatcttccatcattcttttaaaataaattgaactttaggaagattaagtgaatttcctactctgggctatcagtgctaaacctcggtgtcctaatgcctatggtaggtgtttttttctgactgacatcacactgtcttctgctagagctgtcttgaagctatatattgtacctcggtgatctcatctaaccagatggctccaattatcactatatagataattctcagaaacaatacttctagacctgacttgtcccctgagtgccagacccatatatcctttctgtgcaatcttgtgcagccataagaaggaagtgcatttgtttattgatatggaaagatgtgctttatatactgattaaaacatgaaaattgcagaatattaaaaataataagagcttatttggattttttaaatgacacacacacacatatataaatgcataatgatatgatcaacacacacacatacacatacagacacacatgtatatatacataattatatattatatatacagataattatatatataattatattatatataatatattgataattatattatatatattacatattgataattatatatatatacgtgtgtgtgtatgtgtgtgtgtgtgttgatcatatcattatgcatttatctctgtcatagctctagctactgcattatcatatacaaatgtctgaaagaatatacactaaacagttaatattgcttggggaaaatgttcagtgagagtagaccccttacatattttattagtatatttctctatatttggtatgcatgtgccattgttgtgattaataaaaataaattatcgaaaaaaataaaaataaataaataaaatgtgaaaaaataataaaaatttttaaaagatcagcacagaacaaaccaatacctttaaaatgtaaaggattaccaaataatcaagatagtatggtactgtccatccacatgcaaaataatgaggttggacttttactttatataaaagttaactcaaaatggatcagacacctaagtataagagctaaaactataaaatgcttagaagaaaacaaggataaagctttgtgacctatgatttgacagtggatgcttatatatggcaccaaaagtacaagcaacaaaacaacaaatttataaattgtgcttcattaaaataaaaacttttgtgcttcaaaggtcactatcaagacagtgagaaaacaatccacagtatgagagaaattatttgcaagttgtctatctgataaggcacttgtatctagaatatatgaagagctcttacaattcagtaataaaatgacaacccagtttttaaaaggacaaagaattttgtattagacatttcttgaagaacatatcggcaataggcacaggaaaagatgctcaacatcattagtcatcagggaattgcaaattaaaaccacaatgagacaccacttcacacccactagaatggttataataataaaacagaaaatagcaagtgttggtgatagtgtagagaaagtggaacccctgcatacattgctcttggtaatgcaaaatggtaaagccaatgtgggagacagtctgtcatttcatcaaaacattaaacatagagttacttgacatgactgttcatagaagcattattcataatagctaaatggtagaaatagcccaaacatccctcaattgatgaatggtaaaccaaaagcaatgaaacattgttacatgctacatatggatgaactttgaaaagaactagtcacaaaagaccatgttatatgatttcatttatataaaatgtccagaactgataaatctactgagacataaagtggattagtgattgcttagagttggggtgtgtgtgtggcagaattgggggatgataactaaaggatatggggtttccttttggagtgataaaaatgttctaaaattgattgtggtgatgattgcacaactgtataaatatactaaaaaccattgcattttgcactttaaatgggtgaattttatagtatgtgaattatatctcaataaaactgttacaaaagaaacaacaatataatgactccactcagtgaaaattttatacagtggccagtgccgctggtccagggaccataccttaagaaccactgaactaaacgatcttcagtttaccctttttattcccccagactccaggttaaccagaggtcttcattcactgaccattttagttgagattttattataaattgctgttggatataattagttgccataggattctccttcattgatatactgtactttagggacttatagtcattgattgcacagtttaggagctttgctgtctattcttattccataggatgaggaagaggatctcaggactgaactcaaccttctgaggaagtactctttccacaaaaacattgtgtccttctatggagcatttttcaagctgagtccccctggtcagcggcaccaactttgggtatgtttttaattacactgttcttattctataagaataagttttacccaaggatgtatgttttcatgagttatcacttttgtgcatctacaggaaaacttagcacacaactgttaaggtagtatggtgtattaatctggtctcacaatgctattaggttggcgcaaaataatcgtggtttttgccattagacatacccgagactaggtaatttataaaggaaagagttttcattgactcacagttccacatggctgaggagacctcacaatcacggcagaaggcaaaggaggagcaaagtcacgtcttgcatggcggcaggcaagagagcatgttcagggaaattccccattataaaaccatcagatctcgtgaacttattcactgccatgagaacagcgtgggaaagaccggcccccatgattcagttacctcccacgacatgtgggaattatgggagctacaattcaagatatttgggtgtggacacagagccaaaccatatcatttcatcactggcccctcccaaatctcatctcctcaggtttcagaaccaatcatgccttcccagcagttccccaaagtcttaactcatttcagcattaactcaaaagtctgccgtacaaattctcatctgagacaaggcaagtcccttccatctatgaacctgtaaaatcaaaagcaagttagttaccgtagatacaatgtgggtataggcattgggtaaatatgcctgctccaaatgggagaaattggcccaaacgcaggggctacaagccccatgcaagtccaaaatccagcagagcagtcaaatcttaaagttccaaaatgatctcctttgactccatatctcacatccaggtcatgcagatgcaagaggtgggttcccatggtcttggccaactctgcctctgtggctttgcagcgtacagctccctcctggctgctttcacgggttgacattgagtgtctgtggcttttccaggcacatggtgcaggctgttggtggacctgccattcagggttctggaggacagtggccctcttctcacagctgcaccaggcagtgccccagtggtgactctgtgtgggagcttcaaccccgcatttcccttctacactgccctaacagaggttctccacgaggacctggccactgcagcaaacttcggcctggacattcaggagtttccatacatcttctgaaatctaggcagaggctcccaaacctcaagtcttgatttctgtgcatcagcaggctcaacaccatgtgtaagctgccaagacttggggcttgcaccctctgaaacaacagcccaagctgtaccttggccccttttagccacagctggagtggctgggacacagggcaacaagtccctaggctgcacacagcaagaggaccctgggcctggcccatgaaaccattttttttcctcctaggcctctgggcctgtgatggcaggggctgctgtgaagatctctgacatgctctggagacatttccccattgtcttggtgattaacgtttggctccttgttacttttgcaaatttctgcatttggcttgaatttctcctcagaaaacgggtttttcttttctattgcataatcaggctgcaaattttccaaacttttatgctctgcttcctcttgaaccctttgctacttagagatttcttccagaagataccctaaattatctctctcaagttcaaagttccacatatctctagggaaggggcaaaattccgccagtctctttgcttaaacataacaaaggtcaccttcgctccagttcccaacaaatttctcatctccatctgagactatctcagcctgaaccatattgtccgtatcattatcagcactttggtcaaggtcattcaacaagtttctaggaagttccaaactttcccacatcttcctgtccttctgagccctccaaactatttcaacctttggctgttacccagttccaaagttgcttccatattttcaggtatctttacagcagtgccccactctactgacactaatttattgtattagtctgttctcacgctgctcgtaaagacatacctgagccttaataatttataaaggaaatttataaaggaaagaggtttaattgacacagttccacatggttagggagggctcacaatcatggtggaaagcaaaggaggagcaaagtcatgtcctgcatggtggcaggcaagacagcatgtgcaagggcattcccctttataaaaccattaatctcaaatctcgtgacacttattcactatcactagaagagcacgggaaagacctgcccccatgattcaattacctcccaccaggtccctcccatgacatgtgggaattatgggagctacaattcaagatgagatttgggtgagaaacagccaaaccatatcatgtggcaaaatatactatgattcctggagatgacagtgataaaatatgggaaaataacttaagtgcctggcaaggggattactggtgggatgggggaggactcaaatgaatactggaaatagtcaacataaatattttcaaatattttatgtaattactatggttgctattacagaaattacccaatgaactaataaataatgactggataaggataaattctaattagcacttgacatgagcatatgggtgcattttaagtttttgcaaagtatatgcgcttatggataaacataactcctaagaaactcttttccaaatggtaagttgacttatccttttcttagtcattatgcctggtgtatcacaaattctagatcaataagatataaattgtagaggataaatggaacctatgctacctaagtcacagttaccagaatttttgctgccctccactgtggtaaaaatagttaaatcacaagaaaatcagttttggtcaaggatgtctttattaaaaattgaatatttagaatataaggtggggttagtatacacttgaatctctatacttgctgcatttccattccatgtccaagttagtagtattttttcaaaataatgactaaagcttttcagtatcttcaagtggcaataaagtattctattacattctaaataatggacttcagaaaataggacagtggacattatagaaaggttttcaacaaggggtggaattgaaacagtggttctctaaatttggcagccatcagaatctcccagagagcctgataaaacacctatttctgggcgtcactcacagaatttctgattcagtagatttgggggtgtgggtccaaaaaattatccttcctaataagttcatatgtgatgctgctgctactgctggactgatcaccacactttgagaaccaccaaatttatagaccttcagcttaactctgttttctctcagatgtccagttaacatgcatcctctattctctgacaattccagttgagattttagtaaatatggctgcatagtttagttactgaggaattttttttggcatataccatttgtcttttttatatattttcacttacaagtttttttttcctcttgatagtatagcaaagtgtgagaaattttgcagtctccttactggatatgtattagtactcagttcattcaggcattcaacatatatcaattgaaaactatctatttgtcaggtgttgtgctagatgctgaggataaaatggtaagctgaatagacatgctcctgacccagtggtgcttacaatctatttgcaaagaccagcgtcaatcaaataatcacacacataaatgtataattggtcagaagagaaatatcatggctgtctgtgggtgaataacaaaccttaattaagctgggaaatgagaaaaacttccttgaggaataaaagcttgaactgagatctgaaggatgaataaacatttaatgcataaattatttgtgaagataagaattttcatgggacacttcacaaattttggcctatataaatcagaaaaacaaataggaagtaagtaaatagcttaataatgaccattaataaagaagtgtacgtaccaggcaccatgcttacaaagttaggaaaattactgagaatgtcttacattccttttatagttgagctcttctgactcacataatataagcaagatcttccagggtttatgttagttgaatggctttaattctggtttgtcatggttgaaaatgaggagttaccacagtgtacatgttgtgcccattcaatatagtcaatgcttaattctccacgtgaaaatcaactttttgtggcttatctgttttcgttttgtttggctgtctcttcttctttttggtgaaagtgtactcaggtgaaagacatgcaataatatcaatggtgaataaccgtaaattaggggagtagttttctgaaaagaagatcttaatattccacaggaagtaaggtagactttttgaatagtcatgattttgagtttatccttttgcttccattcatctatggtgataattaatttgcacaaagttaaaaaaagacattttgctcttttgataaagtatttttgaagtgggcagtaatacataaacctgtactcaaagaaaatattgctaggataattataatagttatatgctcttgtacatcactctttagttaactcatattacctggatgaaaatttactagttgggccctcaatttatatgtgtcaaaaataaactttctgagaaactgagtttattaatacaataaaatctgaatgaaatattattgaagatattagttttaaaataggttttccttagtagcaatcccatttggatgaaattatcccacaggaatgcaattgacaaattccaccttggagttgtagcttgccagtatcttgaagaaaatagtttggaatttgaaaataaaaacaaaacaacaaaaaccaaacctagccttaatgttgaaatgtaaactcttttgagaccctccatattttgcttcttcacccctgattaaactgtttccttgaccatcctttccttcccattccagtcgtcacttaggtttgttccttgcacaaacttctttctaaaagcatgtgtttatttagttttccataaatggaatgttcttccttttaagcatatacaaacaccacctatccttcaagacatagctcaaaccccaacttccagttaaatatctctggtgaaatacctggcttctctgcctccacaaatctttggttttaatccaactctctctaatttcgctagcctttggagtcttccatcagacaattgaggcagtacttgcagtgccttaatctctaaacattacatatagatacaagccatatggactaaaactctccagatattttcagaaaattggacactaattttttatactttgctggctttcctgcagatggtgatggagttatgtgcagcaggttcggtcactgatgtagtgagaatgaccagtaatcagagtttaaaagaagattggattgcttatatctgccgagaaatccttcaggtgagtcttcatacagtcattctcttctgatcttttaagaacctgggagtaatatatacaatgcaccttatacctgctcacatcagatagtttaggtattccaaacataacctgtgcatcaggatatctgaaaaggccaaaaagcttttgagaaagccaatttgcagctgacgcctttaaataagctgggtaacaaactcctttgaaatcatggcctttaatacctctgtcggattaagactactgtgttcagtggatcatggaaatgaccacttggattatttattatgttgttattattttagagttctttaaacaaaaacatagcacaagcatcatagattaagatgaagatgagtcagaagaagtcagtattttatggaatggcctcaaaccaactgtagccttttggcagacaaacattttctttgattactgccccctttttaaatttctttattttccacacccagttggatgagagcaacaatcttcttgatgtaccaaattccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacattgcataccacatcatgggttagccaggtcatgggtaaattttagtggtgaatgggctagagccaaagtgttaagccaacacagattacaaatgctgtaaaatgaatttccacattcccctaaattctcagcctacaaagctgactagaaaatattttggactaaacaaatggttgggtaagaaatagagcaaaactatagctgagctgtgatattcaagatgtccagatctttactcttatggctagttggaaatacggaggctaaaaaggaaggtaaagtggcccaatgtatacaaacattacttttggtgctcttttttttcgtgggtgtcctgatttattttcctttccttatagccaaaagtcatatttctgggaacgggttgtagtgattccagcctaaagaaagaattgtgtctgaaacatcaaaattaa

SEQ ID NO: 4844 - DNA, 136065 bp, human
cagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttgaagaaataaaaccaaatgaagaggtgaagagacatcttaatcacttgtgttgaagtttgcattttgatgcaaagtagagttgataaagcaagtaaagaaaccttcatatgatggtatcccttgcagtaattatcctcaataggacatatgtggaggtcagaaaattgccatctgtaaacaccaagtataccaatttggcaacagccagacaatgagggaagattcaaacattggagttgcaaactgagaaaaaacattcagaatgtggaagaataaataaatatgactctagtttaagattgatacattatgtcctttgcaggcctagccagctaaatgaccacaagacaaagacccttgagggaggatagacttgctttacaaattgagaattgaagaaattggtaggttatttggtatttttgttattagatagatattatttttaaacctaaaagagtaaacaggaatgaaagctaggaaacaagaaacggtgacaaaattatataactttcaacattaaaacattcacttttatacaatgatataactttttcacgtaatgcactaaaatcagagacaaaataagagagccaatgtaattacaatagatcaattccattatgtttgttaattaatgggttactgtaattttctgattttctattgaataaatattttctataggtgaaaaaacaaaaaaggaagtgcagagatttgtggtttgtgtttcctttctgaaaagagaagtacaaagctttatgtctttatatatatctttgtaatatatgtgtgtatgtatattcaccttgcccaccagcaatacctagggatgtgcgtgtatgcctctctgtctccgtctctctctctctctctctatatatatatatatacacatacacacacacacatatatacatatatatgtttgggtgatatatatatatatggtaagatatatatatgattatatatatatggtaagatatatatatgatcatatatatgtgataatatattatcatatatataataatatgtgataatatattatcatatataatatatatgataatatatatttcatatataatatatatgaaatatatattatcatatatataatagataatatatatttcatatatataatagataatatatagtatatacattatatataatatattatatatattatcatatatataatatatatataatatatatatattcctagtatgcctgtgtccttgagactggaaactatttcttcctctccaaatctgtcatgtctttcactatgactatcccctttgccttctgtgcccagtatggtaatgacattcctcacggctgtggccttggtatttgacactgccatgtgcagtcctaatctatattggggtcaggattagacaggccttgaggggacagtagtggcagaggttatctgaaatagcacatgatccaaaaactatatttgaaatacattaggcttatatttaaatataactgccagctctacccagaccaggcctgctatccacatttggtcatgagaaatttcccactttaccaagttccttagccccctgttcagaagcagttttaccttcatttcagttaactataattgaaatattcagcataatcctcaattacatatatatagagcatcacctctgcataacactgcacatcagtttattttctcagtcttttttccagtttctagagcaatggttttcatatggtagtgcacaagaacagcgcacaaaaatcaagaataatttggagattttgggacccatgatcaaaaattctgatatcgtaattccaaggaatctgtatttttaacagtattacccagatgattctcacgtagcgagagtctatacagtctacagtttgagaaacactgggctggatgaagagatttcccctttaatgccaccatgtaaattgtgaagcccattcctctgactatctctgaaactcactcaggcactcatcttgccatatccatccctttcatgttctctctccataaactcttttcataaaattgctgtttctaatattacaaataaaaggaggaaagcctctgctgtctccttcaaggtactgtgcagtctccttctttttgcagcctgactgctggagcgtgtttcctcactctcctttactatcctaaatttgaaatttcttgctactcatgttgaccatttttggttcctttttctccttagtctctgccatatttggttctgtggatcagcttctgctttgaaattctctcccttgaccagttaacactgctttctattggctcttttccttccagttactcccatccctggcttttattaaaattagccatcaagatggtctttcttccctgcccttgaattcaggagacagaaacgactccccagaatttgagatttcagtgggcagccagactaggacttttaaactgcaggagataatttagatgcatagaaagagataacgaaagtacaacaggtttgtctaacagtttatggttcaaaaatgttttaagacttagatttttagtaatttattgtaagacaaactagaaattagtttcttctttactgaccattttgtatacccaaatgggacatcaagacataccaaacccccaaataatctccaaattggtatagcagtcatagatacgaacatctaccttctggttttcttatctcaaggtggcagggcagaggaaaggaccaaataattatggaaacccctctgacgtggaacttctattttcacagtgaccaaaaagattgttcctttccaattcttccttccttggaaacccagaataaacttgctctgactgtaagtgcaaaatatatgaggaatttggcgttgttaacctagtattaagcatagtccttctcctcttttccccaatttaacgtttagtcttgaaagagagtagcatggagatggggaacaaaaatagcatatagaactaaagaaaacaatatagtcttagaatatatgaatactaagttgagctgcctttaagaggaaatttttaaaatgttcttttattaaacatgagtatgaaagatggtttggtcattcgagagcagaaatcaagtttcccaacatagatatgaggcctccatgaattttgacgggcattttattctagtccatttccttggtgtcttttttgaataattaggtaactgtattcaaatcagggtaaagtatttatgttattgaggactagagaaaggaataaagaaatttaagactgtgctcaaagattcaaaaataaagcttgtacagatgttacaataattctctaatatatggtatcttttccagctaaaatgcagccttaactatagcaaagaatagtttaccaataggaatcagctaacatgtttgattattttgacagatggccaaagactgtttctccagaattaacaatgtctaaaataaatccctcaatgatatccatcacataaatatgctacagtgataaagtcttcaagtcagtccctagtaacttttttgttggcttttctctcataaatctttcaatgagttataacaaaagtgatatgcttaataataagggtaatataatgatctatttttacttcttagatcctaaaaattatcattttagataaattacatgttcgttgggagtatatttctggaactatttctttgaaatgataactgtgtattgtgatcttaactttgatgatcattttgaaaaactaagctgctaggctgctgctttatctaacaatgcttttatcaattcagtggaaacatctagattttagaatgactgatagactatgatttttatctgtagaattttagagctgggagatcacctatcacaagacttttattttatgtatgtgaaaactgaatcccagagagagtaaataacttacccagagtcatatagttaattaatggtagagctggggctaaaattcaagtcttctgactctctgtccagttgaatacttattgaatgatgtaatcccaaagctgtgtcattttcctatgacagttttgctagattacacaaatatcacggcagttttaaggagtttataatttcattcatctaagttgcatatgctcaatagttttcctgtttagcttatatttatcacagcaataaaaatgttttcaaacaggattaaacaacgtttgtgtatataaaataaactttcaataaggtatgtgaatttccaagaatttgccaatgttcttaccactttgtgtataaattggcatctactcatgccttatataagttttgctaaaatagcaaaataggctgctagactaaaagttcaaacagtgataaaattcaagaaaccatattttgtggtgaacaatcaaggagtacccatatttaaaggtaagaaaacaatacttgaagataaatatggaagcctcataactctatcccaaaacatgttatgttttgtttcctatgatgccacatttagggttaagccacagaaaacgtcactttgtgccatgaacaggtatttagcagatgcaaagtttaacttttaaaaaattgtctaattttcttaaaatgatgctcttttaatatcatgatcttgctttgttattcatatttagtgatggtatttcttttttaagagctgttacaggttggtgcaaaagtaattacggttttgccactattctaatgccaaaaccgcagttacttttgcatcaacctataattcaaataagtaatctaaactttgtatccaacatctagtcatcattgttgcatgttaaattttctgcttgtctagttatcactcaaaagaataacatcggctgggcgcagtggctcatgcctgtaatcccagcactttggaaagctgaggcgggtggatcacgaggtcaggagttcaagaccagcctgaccaacatgaagaaaccccgtctctgctaaaaatacaaaataagctcagctactcgggaggctgaggcaggacaatcacttgaattcgggaggcagaggttgcagtgagccaagatcacgccattgcactccagcctgggcaacaagagtgaaactccgtcgcaaaaaaaaaaaaaaaaaaaaaaaaaaaaaaagaagaagaatattaaaagagtacttccattgcaaataaatgaacttatttctattttatctttctaattacatcattaatatgcctcagccttacataattgtgtgcattttacagttttatgataaataattacacgactacttaatgtccatactgcttattcttttttatgaatgagtatagtcagttcaaggagattgtgacatgtctattattttggtaaatgacatttaggttcttcccatgtaaattttaacagaacaaggcagattggaaataccacttaagatagttgaatgcagccataaaaaaggtagagttcatgtcctttgtagggacatggatgaagctggacaccatcattctcagcaaactatcacaaggacaaaaagccaaatgccacatgttttcactcataggtgggaattgaacaatgagaacacttggacacaggaaggggaacatcacacactggggactgttgtgtagggggaggggggagggataacattaggagatatacctaatgtaaatgacgagttaatgggtgcagcacaccaacatggcacatgtatacatatgtaacaaatctgcacgttgtgcacatgtaccctagaacttaaagtatatatattaaaaaaaagatagttgaatgctcacctaatttcctaagaagattaacaatttttattttacttttttgcaggatccaactggaatattctcactagataaaaccattggccttggtacttatggcagaatctatttggtaagttgacttacattatttattcattcttcattttctaatgacaacaaagattgtgagtcagacactgcaaatcacataatgccaaaatatggcatttcactttgagagagaaatcaaattagatagcccagtgacacctgtaagaattactgtttattatcacaaaagtaatggattggctaatctatagtgtaccaaccaaccaaacataacatctaaaaattagcagaaaataaagtcaccaatggaaaattgaagtaattcaaataagatatacccaaataagatatcacttgtcttatagtatacatccataccattctaaatactcacattcaactgaaaactgaatgttattaaaaggaatgttttcataacattctatatcatactgtgtacttgagtgtgcacatgtgtgataaaattttctaaagaatctaacaagaaaaaatctgaatttatttagtgattacttatggtaaacactaagtatgtgcagatgctgtgatagtctctgggaataaaatgatgaacaaagcagataaagtcccttctcttttggggcttatggttgagaaatgtatgtgagtaagtatgtatatgttatatgtgttgggtttgttgggggagccatacattacataagtaagcacacaaataactgtatacttctgtatctgtgcgttccacatccatggattcaaccaacattgtatcaaaaattaaaaaaatgcgtaatgtacagacttttgttcttgtcattattccctaaccaataaagtgtaacaactatttatatagcatttacattgaattaaatgttataagtaatctagtcatcacttaaattatactggaggatatgcgtaagttatatgcaaaaaaaaattactgtgccattatatatcagggacttgagcatgccctgattttagtgttcacgggaggccctgaaaccagtcccccacagatactgaaggatgactgtaattgcaactgtaatataagatctgtaagaaaattcttagtgatgtaaaagcataaagcaagggggcttaatttagattgaaatgtcagtgttgatctcccactccctggaaagggaaagtgaccgttaaactgatatcagaaggataaatatgaggtaaccaagaaaaggtgtggttgtggaggatgatgttaatacattctaggtggaggcatggacagtgttaagggctggtttggggatggggtgctttagtagccatatcacactgatcaggtacctttctattctctaatatggggaactgacattttctcaatcttgtgtaatgttctatataattgcagtgttctttttccccaggcctgttgctcaaaaaccggattactgtccttaggctgatccttacagcagactgatcacaggtcctccacatataggttgtatagaggtgtcctagtataagcccagaggagaaggggcttctttctagttcagaaaagggtgccttttttcttgccaagtcttgcaactttgggactacatctacccagaggggcttcttttcttattcatctgcccaggtgggaaaggagtatgctttttaaactttgcacaacagctcctatagggcctggtgctgtggctcactcctgtaatcccaatactttgagagatgaaggcaggaggattgcttgaagccagagttgagatgatcctgggcaacaaaacaagaccccagctctacaaaaaattaaaaagaaaaagttagccaggtgcagtgggtgtgcacctgtagtcttagctactcaggagtctaaggcagaaggatcacttgagcccaggtgcttgagactgcagtggattatgtttacaccactgccctccagtttgggtgacagagcaagaccttatcgcttaaaaaataaaaataataaaataataaactaaataaagcacccatagcatagaaactgagtagtagaaatagcatgtggacaggtcttaaaaacagaaagaaccttggtgaatatagggaacagagggaatgctagtattcatgaccaaatgttttcaaaccattttgatcatatctattaacagaaccaataagctatagagggtgatataatatagactgaaatatattgcttaggctacctcaattccatcctgtactgaatgattatttaatatttgtgcgatctaggtcagttttgccaccttatacatagatacctacatcttatacatagatacctacatcttatacatagacaaaatatttatggtacatttacagtctccatggctgtatgcacattttagttccttagggtgtgtgtgtaagtgtgtgtatatacttgttctgattcaaatgtatagagccaccagatgtgagaaataaaagctcagagtcatataaggtaagaagcaaggttaaaattagacaacacagaaagatggctactcattatcattcatgtgataatgaactgtgatggcaccaaaagaagaaaagtaagacggtaaaaaggtaagttatgcatgtgaatatccttttttaaaatcagggtttattgggatataatatatatttggtaagattaactcttttaagtgtacaactttatgagtttggacaaatgcatacagtcatataactgccaccacaatcaagattttcaatgtacatcttaaactaatcacagtctagattcaaggagtattctacctcttcactgtgtggtttcccaactggtgtactctagggttatggctgtcaggcattttgcttttacatatgctacaaacccacaaaactactgtactttccctatacttactcttttccctgttttcactactactatttttaaaatttagctaatcaattatcttttacagcaattaaaagtcagaaagagtcttttatgtttatcttcattttaaccatttctggaatcttcatttctttagtgtagatccaactttccctctggtgtgtacaacttaagcctgaaaaacttcctctaatatttcttatagtccaaggcttctgagtaatgaattatctgcttttgtgtgaaaagtcttaatttctccttcatttttgaaagatattcacactgtgtataaaatgtggattgagagttattatttttttctttctctcagcagtttaaacatgccaatttgtcttcagacttgcatagtttctgaagtctgctgtaattcttacctttgctcctttatattttgtctctggcttcctttaagatttttctctttgtctttgtttttcagcagtttaaatatgaaatgtctggaggtgtgtgcgtgtgtgtgtgtgtgtgtgtgttgaaaggatatttatctgagataatggttagagatctttggggttctcttagcttcctggacatgtggtttgacatatttcattatttgggagaaatttttggcctttatcttttcaaatattttttctactctatttgctttcttcttcttttggaaatccaatttcatatgtgttaggccttttgatattatccctcagttcttaaatgttctgttttggagtgtgtctgtgtgtgtttcattcttttttttctctttgtgtttcagttttgatcaattttttttctatcttcactttcattgattcctttctcagctgtttcaagtctacttatgagagagtcaaggacattcttcaactatattactgtttttcatttctagcatttctacctgactctttaatagttaacatgtgtactgaaatcccctatttgtttattcatgtttttcatatttttcactaaagcatttcatgcattaatcatagttatgttaaattctctgtctgatggattcaacatctaagtcatctctgagaggctggttatgttgattgctttgtctcttgagaatgttttttattttactttatttcacaatttttgtttaaatgacatagtatgtagaacagtagaaattaaagtaaatagtatttatttcttgaaatgggcacactttttcagctaggttgtttatatgggaattcactcaatctaataagaagataaactacatttgagttatgttgttgatatggttactctcagttcactaccagcttcagattcctctaataccttgtgcatatgtgggggttggtcttctggagagtttttcttaatatccctgttcttttctcaactttccatattccttgtgtatctgtgcttcaaagaggttcttgctccatgctgttgccctcccctaatggtatactgctattgcttcttattaagttctcattggcctggtggtgtgggcaggtagaaatgctctgtttttctgcttcaacctcagtcttgtaagatcctgggcctctgtgtcacaggagtgagactttcttagttatcctttccctcttctagtggtaggatacttctaattgtttgggcccacaactaattcttgcccttctcccaaaattggaggactttttttttttttttacctttccccagctgcagtaggtcttcatctttaccctggggagaatacactttgctgcctttcccctagggcttaagacttttattcatgaaaaggaaaggaactggacctggtttcctacctttcccactgcagtggcttctcatctccatcagatctgtaccataaatctgtatgtttgtataaatttgtcctgtgtctatggcttccaagggttctatactctcatgctaacccacatttgctctttagcagttcactaaaaatttgcatgcttgcaaccaaaatatctcatgcacctcataaatatatacacctattatgtgcccacaaaaattaaaaaacaaagaaaaatttagttgaattctttatacctgcttccgttgtgaccttgtcttccctctacagccacaggtgagctaatgctcatgtcccatctctttttgcaggtgcttgtctttctccagacctcagcctagttggttgccttgagacttctctatagattgaagaaaagttacgattagctagattattcagcttattcttgttgttagggtggatgtggcacactttccaactttcacatcctcatcaaaagcaaaaagtccatgttaattccttttaactgactcttcatgaagaatataccatatgctagatcctcctgtacacatttataaatcctaagaattttctgtgtacctactcagatccagagatagagaacaatttctaacatcagatcttccaagtacaaacttccttgttacagaaggtagatgcttaaaaaaacttcatttacaccagaatgatttccgtctgtcactcattgactttacctctttttttctacctctaattactataaaaatatttgggatggtggtgctatccactgacaataccctcatggaaaacaatctgggagtatgtaaataaacacttaaaaatgtttatcctctttacaccaataattcaacttttggaaatatatgataaacatcccagacatagacaaacatgtagatatacattgcagaagaaaagtagcatattgtggtgaaaaaagggcgtgctttgaaccaggcagacctgattcagtgcttacttagccattaactagctataaccttgagcaagtcacttaacctaagtttaagtttccttatttataaaatggggctaataatacctaccttgggaggtgctataaaatatcaaaacaatatacatatatgtacacatttgtaatatttggaatatggtaaatacctgttaaacggcagttattgccatcattattgttgctattattttttaaaagttcaattacaatagtttaaaaagatggaagtaaattactttttaaccagctaatatatcattgtcctataaagcaatatttatgaagttatctagcagcatagaactatgtttaagatcttaagtaaagtattccttattatatttgtgccccagttacagctatgttaaaatatgcagataaaaaatggtgaattaacgattagaatagtgagatattggattttttcttttctaatgtctgtaatataatatttaagtacagaacatatatatctgtacgtatatttaacatattatatatatgtgtgtattagacagtaccaaatgttgcataaataacctgtactgcaaaatagaagcatgataccattcaaaattaatgtcagagtgactcatagagtcctttgctttttcagtgctgccaaccacatcccctgctggagtttgttttggttaaagtctctccaatgtcttccagcttgtttccaaggcttcgttccctggcaggtttccagctgtctgctgaagtctgtgcacattgaaatgaaggctgagtctcacactactattgtaatcctcttcctttccttctttttcctctaattagatgcctatcctctcaccctctcccacctcctgccagttcaagcctcacttgaaattgtgggttctatttttctctctttttaggagagaaagtactggtcttctcttttttgccccagtagagttagagaatatagttttctcctcacctttaactgctagtctcatagtttatgggtcgtcattttaattggaggaatgtttagtatttgaccatgtgaggccatattagaaaaaagaaaataggttggaactcatttttaatggtactttttaaaaaaagtaatttccccaagagcaatagacacagaaagaccacagtattaagaaagagaccaagacctttagggtggcaaaattggaggtggcaacctgactctcccagtaactgacagtaaacgtgtttcttgactttctgggcccatttcttcaacaataaaacaaatgtattagactctataatctccaggctttcttctggctctgagatattgcacctagcacagtgcctggcactcagtaaaatgtaacctattcttattcttactgtcatcagcataattatagtgatcctattgtcgcttctccaccttacacagtagaagttgattattggctattagctggagtagtttcactttttaccaaataaaattatttttaacatgtttttctattcttttcttctgttttaccacctgatagtgagacctgatttttagctcagtaactaataagacactcaatgtgaatgtaaaactgggtagctggtatattgggaaggtaggaatgcttcattatatatgttatctaacaccattttgttaaggttaatactagtgaggtgagacaatgaattggtatccagaatgaatgagtttgccttggcccttcatgaggtcttgactacacccctaatatcagtcacctactcctacgttaccatttgcaggtggtgaggacagaaaaaggaatgggaaaggattcaaggcaaccatttcaagcaaaggaaaaattcacctgaaatagagtaaacttctacagttgggcatacagcctaattgccatgtacgctgatgcctagttgaaactcagttaaatgctggtggaagaaagggaccaccccaagtttcttattgttttaacacctaaaaacagaccatggccatatgtgagcatccatccttgaaagagatcacaggagtcatctgtcttcttggtggtcagtagattaagtgaggtatatgaaggtcacagtcaggagcaaattcctgaattgtttgcactctgaaagtatacaattaaatatggaaatttcgtttcaaaacaatgcatcacccttaaatttggttttataaatcaccgcctgacacattgcttttatttgcaaacctcaccagacagttgagatttatgtttattagttatattttctggatttgaagttggtgcagggaatgggaatggaaaggaaggaaaggaatgttgtcctcaaagttgatgacatacaatttatgatattttaaattacatttcagaaacacagtgctgacatttgggttgcctagccactaggcctattggatgggggtttgagtatttttccttttaggctgaaattatactgtttatttgcctaccaaatgtctagcactgtgaatgctttctttttaggtagaaaagtttccctcacatccttgccattttgcaaatatagcttaattaagtcagccaacaaataatgcttgagcaccccttaaagcacatagcactatgcatttcattatacattgcaagtttctgaagcaggagctgaagctgaagctgagttgaggccacaggcatactaggctattgtgtcttcatagtacagtgccacaagtccagagctatgtcttggttccaccttcatcctgtgacattgtgataatgtgcctcaaaagtagggattgatatttcttaaggaaccctcaagctgctctagcatagaaaacattaaatttacctattaacattgatttgaatgtgtaaaccattctgtaataaaaatttaaaaaatacatttattgaatgcacagtatgtcccaagtatcatgttacatactagttgctagttagaatgatcagaatacattttttaggagcggtcatttttattaagttagttttagtagagataaggaaggaagtattttctgtatgaccgtgaccgctttatttgaagagggagtgatgggtaatggaaaggagtgagagagattggaaaaaatgaaaagaggaaattgggacatagtttttttgtttttgttcctgtatgtagaaagtctaatgaagcttctaaagaatgagactccaagaacaagtttttcctcaataagaaaacaggttgaatatttgcaatgggggtgaaaaaaacagcataggctaaataaattgagactcaggggaccaaattagtggaaattgctgaggcttacaggccttggagaaaaatggaatatttctatcttggccgtgacaactctccaactgtggaatagaatccaggcctctgagttgcaggctttactttttcttattatgttataccaaaattttcttttgcttcccaataaatcttgagggaggatgaagcagttggtagctgacaggtatgaaaggggaaagtaaatgtcatgggatttttgctcccaagaagtcataattatttttcacaactactctaatctgcttaatatgttcacagatatatattgggaagtaattcaaattatgtatttggtgtatttgggtaacacaaaatatattatgtcatttctgcagatgcttaatccagttgattgttataaagttgttccaggagcaggaaaaataaatttaaatatttggagacaaatacacatttctaaacaaaagccaaaactaataaattctttatagcatggtggctttggtcaaccagataaaaacatcccaattatgaaaatctttatgaaatgtaagtataaatctccatggcgaaataatgcagttccttaaaaataggcatacaaaattgcctgattgctgctaagcttatatatttaatgctatttttaatatattagtcctaggaaaatttatctgtacaatattttataaaccactttatagagtgatgagggtgggttgggcagtgttagaagtaataatgtactttttaatatatcaaaaagcaaattttgttttattttgcttttgcgtatatatatgtatgtatgtgtctgtgtgtgtgtgtatatatatatatatacatagagagagagttatataattatggtcagattttcagagtaaattctgttaaggtggttgaagtatcacaagttcttgctttagtttatcgtctagtagttgaccactaaaaactagttaactaggtcctcatcacatttcatgaaacactctttggaaaatagcacttcaacagttgttactcttgaaataagaatagtcctaacttgattttaggacttccaacattctaccatacttgtgcatctgtgtctaaggtagttgtgtgggtggtgccaaaatcgcacttggagattaatgtgctgctgtagctctctgagggtgtcaaaagaaaagtggaagctcttataattttatgatgctgaggctactctgaaggcaggcttctaaaaagcagcttatcagtaagactaaattaaaatatcaaagaatataaaaagacataaacagatttttatcctgcagttttattttttcctgcttacctacacccaggttgtaataaattcctcctctaccagagcataaagagagggaaaatgaagtgggaattttgtgttatttcaattgtagaaattatgatatgacggtagtttatgtgtaatttgtgttagaaaactaagaaagctccttttgggtttgtccttcttagccagagtccctttatgactagggaaagaaggttagattgttcagggtcccctgagggaaagaagattgattatattctaagcactgccagtaacattttgtataaatcattaactctgaagagaaaacaaaacaaaaataccaccatgatctaaaaggagaagtctaagagtcctcagagaaagacagcttttcttgactctgagaaataaaataaaataaataaaattattgagtgtttgaactgggtgagaaaaagatggagatttaaatattagtcactttagagatagtgacctcaatgttctaaaaatggataacatttactgagtgcttacagctcataagagcattatgaggtagctaccattgttttcatcatcctaccatctcacaaacgagcaaacaggattcaagaacctgagttactgaataggttcacaaagctaagatattgccttgcaaagtcaggatttaaaccaaaatttgcttggcccgaggtctgtatcttaatcataatatagtatattcagctcaacagatataaaccaaagtcaaaaaacattcaattagattagccaattgaaaaaacaatctgcccaagtgcaaaaatttacaagaaactaatgagctgaggtcggtaatgaagatctttaatgatgtgtctctccaacatatttgtttccttcatgatgggcactaagacagtctagtcttagggtctttttctggaacgtaatagatttcagaaatggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccacctaagtaactttctattctgactataaaaaggtggcactgtgtagagataaatatttccaaaggatggaaatattagccttacttttttattactttctgctgaatgagtcatttaggaagcttgaaagagtatattttttctctgggtactgtagtttgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcagggactagataatattcattgtttcttttatattccctgcagtagcactgtgctgaatcaaactttgttggttaattctatattttgtagttttccttattcaaatcttatattccagggccctgatgaccagatagaggggtgaaggaatagagcctggtaagtggggaaagagagaaataggatgcaagagaccttagaactagggttgccagatttggcaaataaaaatacaggatgccaagttaaatctgattttgatgaagaacaaatacatttttaatgtaagtatgtcccaacagcatatagttatactaaaaaaagtttacttgaaattcaaatgtaaatgggcgtgttctttactttatttgccaaccttacacagaatcaactttacccccatcacagatttgccacctgacaacgtcatgttaagaaacaagaaagaaactgactctcccacctgctgtggtgtggcagagaatcccagatcagcctatctaagaagctgccaaagggtggggaggaggtggtcttctggtcccagaacagctgctactcctccctgcttcttctggcaaatgttttgtagtgctttcagagcttcataggaatgcggctttgctggcagctgtagggatcattgactccaggtgagtaattctctcctcattgaggggctgggtcaagaaaaaaagaagagttttctccttgacatgccaaggagagcctttgcctgctcagtcccctaggctgtagaagagaatcaaggtcactctgggtttattttttcctactccataagggaaagggctcagggctggtgacttgaattgattagtcactctccggttttattatacctaatataggcccaagcccctagtgtgattgcaatcaatgtcaatcaatgatattaatttttttggtgaaagaccttatgttcttctgtttcacaggccaggctatcactggctttaatctatagatttctcacagaaagaccgtttgtgtcatttagagccccattgcatgcggtccatctctgtgatttttaagttaaattactcattttatctgtggtactgagaaatttaccttaaggaaggatatgtaggacatgaatggtcagtgtgtggagtggaattgaggcagactgccggcagaactgcttaaattcaactgtcacatcaccctgctcttaattctgttaacatagcccagagaatatactgttttttttttccattttgtaaataatgttcttcgaggataaataacaatctgcaaaggaataacacttctgtagatcctaaaaagattacaaaagaggcagcaatacactgtagatctccaggtgatgtaacattgttatttatgtcctctctgaatttgctaagagtcttagtggagacagagatagagccagaaacaacgtcaccatctctcagccctcgggaacttcatttgctgtaccttctaccatcatcaactctctttctagttcttcaggaaaattagtttctcattaaaaagtgagggagactatttgctgtaatgtatagatacaaaataaataagtcttagattctagccaattacaattcaagataactttaattaagagcttattgtataccagatactattctatatgctttataggcattaagtcatttgatcctcataggaatcccatgaggtagtttttatcaatgttattctcattttgtatatgtaactgaggcatagtgaagttaaataacttgtctaaagtcatgcagtaaatgtctgagccaggtctgtaatgagatatccctggcctgtaaagccctcacttttaactgtgccatataaaactacaggagaattgttaagttttaaaaaagcagtacatttgtacatgatatactcaaatcagtgaggaactggaaggtagttccaccaagcccccaaggaacatttataatgaggatccaatgtctacaactctcccagttccagtaccattattgttttcctccagtctgtgtcaaagagactttctaatgaaaacagagagaattaatgaattatattttcagtcatttgacaaagccaaattacatggcatgttatatggggaatattagaaactacttgaaaaaataattagcaattcatgaagtgcctgttctgaatagtaaatatttaagaaagattcaattaaattttctagtagctagctttttattacagaatcagttttatgtaaaatatttcaacagcagcatgcccagtgcacaatataggttttggaaccaaccagaacaggaataaattagacatgctattgatattgtgctacacagtttcaaaagggaaagttctctcaaaaaagctagacagttgaagcatttaaaagactaatcgctttgacaagagccctgaccaggaaggtatcagtttaggttcatggaatacattctaggtcatcagctaaaaattcatgtagagacttattttcacaagtttagagtatgcagcttccatctttctataatcatgtcatactagtcccctgccatgccacagtgggagcatgtgctttggcatcacataaatctgattttaactcatggctccatgaggtgagtgaccagggagtgagttgcctaacttctgtaagccacagtttcacaaaactaatggggacaataaaacacattatgcaatgtatctcttatcatcctatgaaaaaacaggcaaaagttttttatcaatatggagaccagtattaaaatgttattagcattgcaagtggacaaattggtagatgaatatctttaatacaaagtttattttaatattcactactctgaagctgaggcagatgaggaagaatcaaactttaccacaggacagagctgataggactccattcaggtcgtaggtcaatccgttatttatagataacaaaactcaagccctgagaggggaagtgacttcctttaggtcaaataactaaagatgtagagcatccctttgctatagaaataacacgtccttctccgtccctaactcactcccactcactcaaggtttcccaggtattacctaatactctaatttccaggtagttatcctctaagtatcttacttctttctaggaatctgaaggtgaaatatctcattacttttccctctcacataagattgtgaataattaaaatggtggtaattctgattggtagtaatagctattcttattataacagtgaaactataatatttttcaaatcagaaatgattcagatgtacctacagaatcttatgaatgacagctctgagtaaatgatattattcaatttaagttaaggaggcttattgatgttcatcaaaatacaaggagaaaaatatctcataaatcagccttaagttactgcagcctctaacaaatgaaccctctatgttcagttcacatcagccccacttcacatctctttttcttatttcattttaattttacatctcacctcctcattcttgctttagattctgacaatttcagtgtggttaacaactgtgactgataggaatcttttcaatatttttggacagaatctggagatatgttaatgatttattagttgattttccagaatctgtttccaccattcttatcttcatatgctttttattattatgtaaaattttgataatttgtccctggtatattagatggtgatgaacatttgaaagcactgaatcaaatgaaagcttagccttcctgccttgccttaaaatatctctctgtattgtgccttatgcggccctgtgtattagtctgttttcatgctgctgataaagacacacccaagattgggaagaaaaagtggtttaattggacttacagttctgcatggctggggaggcatccaaatcatggtgggaggtgaaaggcacttcttgcatggtggcggcaagagaaaacgaggaagaagcaagagcagaaacctggataaacccatcagctctcatgagacttattcactatcatgagaatagcatgggaaagaccggcccccatgattcaattacctccccctgggtccctcccacaacatatgagaattctgggagatacaattcaagttgatatttgggtggagagacagccaaaccatatcatacggcccctggcccctccaaatctcatgtcctcacattataaaaccaatcatgccttcccaacagtcccgcattaacccaaaagtccgtagtcccgtattaactcaaaagtccacagtccaaaatctcatctgagacaaggcaagtcccttctgcctatgagcctgtaaaatcaaaagcaagttaattactttctagatacaaggagggtaccagaattgttgtaaatacacctgttgcaaatgggagaaattggccaaaacacaggggttacagggcccatgcaagttcaaaatccagcgggccagtcaattttaaagctccaaaatgatctcctttgactacaggtctcacattcaggtcacatgatgcaagacgtgggttcccatggtcttgggcagctccgcccctgtggctttgcagggtacatatttattacctcctgactgctttcacaggctggcattgagtgtctgcaacttttccaggtgcacggttcaagcagtcagtgaatttacaattctggggtctggaggatggtggccctcttctcatagctccactaggtgatgccccagtagggactctgtgtgggggctccaaccccacatttcccttctgcactgccctagcagaggttctccatgagggccccacccctgcggcaaacctttgcctggtgatccaggcatttccatacatcttctgaaatctaggcggaggttcccaaacctcaattcttgacttcagtgcacctgcaggctcaacactatgtggaagatgcaaaggcttggggcttgcaccctctgaagccacagcctgagctctacattggcccctttaagctatagctggagcggctgggacacaggacaccaagtctctaggctgcacacagcacagggaccctgggcccagtccacaaaaccactttttcctcctgggcctccaggcctgtgatgagaggggctgccatgaaggtctctgacatggcctggagacattttccccattgtcttggtgattagcatttggctccttgttacttatgcaaatctgcatctggcttgaatttctcctcaaaaaatgggtttttcttctctgctgcatcatcaggctgcaaattttccaaacttttgtgctctgtttcccttttaaaatggaatgtttttaacagcacccaagtcaccttttgaatgctttgctgcttagaagtttctttggccagataccctaaatcatctctctcaagttgaaagttccacaagtctctagggcaggggcaaaatgccaccagtctctttgctaaaatgtaacaggagtcacctttgctccagttcccaacaagttcctcatctctatctgagaccacctcagcctggacttcattgtccatatcactgtcagcattttgggaaaagccattcagcaagtctgtaagaagttccaaactttcccacattttcctgtctttttctgagccctccaaactgttccaacctctgcctattacccagttccaaagtcactttttgggtatcttttcagcaatgccccactctactggtaccaatttactgcaataatagtctgttttcatgctgctgattaagacatacccaagactgggaagaaaaagaggtttaattggacttggacttacagttccacatgattctggagcaaagtcagcaacattgtgagcagaggtagcagcaggcctggtcttgctgccttctgatggaacaaaacgcccttatttctgtatttctgtggttcttaagtaagggtgcacaccaaaatcttctggaggaatcatttgaaaatgcaaatgctcatgacccaccctaaaagatttggattgggaaccactgcttagttgaatttgagattctatgtgtaaactagaaatgtcagaaagggtttattacttttctcagatggtgaaaaaattacgcatatgtattgggaaggaagagattggacttaatgtggtgtgatttgcaggaaagatatctcagaccaaaaatatgttccacggaccagccttccacatttctcaaaattccaattattagagtcattcttttggacttcttattagaaatcacctgttcaagtctatattataaattaagtaatgcattaaacaactaattaatactttagcacagataagagtgggtctcaccttaatcccaagggaaatgaggcacatggcaggtaaattatttttgatgagtgtgagacagttgagaggagagttttgtaacaagggtagtggttccttaacaaagcaaagcgagatgtagcacctctgtaaaaggagagaaccctaagggcaccatgggaggggagggggttgaaggcaaggtacacttctgccagaggttatccaattgcccttgatgaagggagcctgcttttctctcttacaggatcaagtctctcttggttacaatgaccctccactgaccctggttcatttaaatgcaaagcaacaaaaggggaaaggctggagggatttaatcctaccatttaggctacatagtattaaacagctgattgatttggcccattcagtgaagagaaagcacacactgtatattcaaagcaactgttcgagtttatttgggaaaacagttaaaccatattagataaatggagaaacgactttctcaatcttttttgcaaatgccattttctgtttgctcacctgaaacttagccagagttgtggagccttctaagtcctctggtggataggagaagtgacttcgggtcaaatattatcagaacctttcaatatgttgagaatgttgaagtggtagcaagcacaggatcctagtctgaagggaggattgaggggatagggaaaatagtcatgtagatttggctgttttaagttaactgacaaatagggaaatggtgaaagttctggtcatggctataaaagaagttttggtacttgggacattagcaaccacgaattctactattccttttatctctctagatttcaataaagcccatttgtccacatatccttagagcagcatatagttaagagactgtgttcccttaaaaatgtggttttgattaatctgcctttggattatccagttgctctttggttggataacttgagccttggccttcattttttttcttttttatatttggccatctaatagagggattaaagcacatatcagatctaagcagcaggatttgaacaaagccaaatgcatgaactctctttcttagtcctccccctttaaagttagcatccattccttaaaacagtaccaatgttttcaattaaggaagccagttgaagtggcatgagtgtgcaccactttcttaaaagaagctcagaagccagaacaaaagtcttggcagataatatagtggaattaaaatctagtcactatagatttactggaaatctgctcaaacctccccaagccccctatatcttaacagtcttgatggcaaaggaggatggagtgactttttaaaaatttttgaatttcttattacactctcgtgaacttcaaatctgtcagccaagtcatgaaattagttaggttttttccacctcctctggcttaccagtttcttcctgtaaagttcagtgccatgtccctgtcgtccttggaatgactcattaatctttcttttatgaccttttggtatggttgattcacagattctactttcacatgttaattcccttagcatagtggttctcaaagtttggcctcttgactagcagtgtcagtatcacccagaaacttgttagaaatgcaaattcttgggagccactccagaaatagtaaggcagaaacaaacccaagtaggagtactggttgggggagcaggcaatctgtgttttaacagattaggtatttccgatgcatgcaccagattgaagagtcactgcctcagttatagcccatcctttgaggtgcttctttgttgcttcattgtgcatattatcctcacttagaaccaggcactaacatgagaaaatcacgttttcattggagtttcaaggtggtttggtgacattgattcctgacactgccccaccaaccatgtgtgcacacgcgcaagcacacacagacacacacacacaaatttaggaaataaaaatattaatcattacttgaatattccaggaaggggatagtgagctgcatatctctctcccactgggtgaatcccaggaaagggcaaaatttccccatgtcaggcatataagtttatatagattatccttcagattaagttcttaggatatatagatttgaggaaggtatttaagactttccttcacaatgaaaatatactgtaaactatgaaagcatgtcttcgcaaattaatataagcaaatatcctgagtcttctactcccacaccataaatccctaaaagtttagaaatacatgtagaactggttttgattatagaattaggtacttttccttgttttgcatatgtatcctgttagtgaactggaaacttaagctatttgttccttacatcttaatacacagtagagtagcattttgggggctgccttcacaaagttcctttttggcaagttggtgatggcagcttagtacaatggtttggagtactgtaacagcattctgcagtaaatttcccagtgctgatggcttagaatttgctaaatgtttctgcagaactttcagatctggaaacctgggcaagatttctcagaaagggcagaagttaaggatggtgatgtagaaagttgtaggattccctctcctgatagaatttacgtagtgagatactttgcagatgatttgaggacctttgttagtctgctgccaaacagactaactggtctcttccagccaacttggtcaatttaataataaataaaccttgtcaatccagttgtttgactaggttgtaagttaactcttggttatttaaaacactggctgattatttcactgaagacacatagcctcaagatacagcctaagtttgatatattcctattaagaaagtgaggaaatattaacatctacaagccacttgcatacaattttatatatttggtcaatggacttcagattaaacataattatttgagtcacaggaagcaaacatttataagttagtatatttcacctacatttcttttaatctgagcccaagttgactgaacccaggttcgctgtgttctggtccataatatgtcaagtggatatgtcaggtgataaatgttcttctattctttctgaggctgggtttcagtatttacaagggaatcctcagttgtaattggctccttttattcttatttgaaataaataaaacctagattaccttgggaagctgagtagtgtattaccgtaagcatgagctttggaatcgctgagacctggattttaacttttaactctgccactttgtgtgtgaccttaggcaaattacttaaactctctgagcctcaggttttctcatctattaaattaagcatgataatacttacctcacaggacatagtgcctggtacataagaaatgctcagtaaatgttagctatcctcttgcaggcaaaggacttaagttgcatttgagaatctaatcttaattaagaggcataaacatggagttgcaccagtgacctggaggaagtaccctgcttgcctttaccaggtcaatcatgagctgtgggtatagatatcacataagatgttgaacagaggggaagagagggaaagggccttaggttgcctctctgtgttctgatttaataacaagtccaaaaggattttttattcaatagaggaaacaatactaaatggtaagatggaagtacataattttaatggaagaagtaaaaactagagttaggagaaataggaaaaacttcataattgaactagaagagcataaagaaataattgtaatacaatacatactgtaagaaatcttattaaggagctacaagtgacagtgggaatgtgagagagaaagaaggagagacatattgaaattattctgattgagaagattcggggtgaggcagtttctgaaagctttatccttagggcctctcacctcctctagctgggagacaagtctgcatttgcagcatacataattgattatctcctcaggtgatggtctcataaatgattctctttatctctaatttataaaacaaaagaatgaagtgaaattattggcagtagggacctatagatatttggagacagtaatattttaaattttgctctgacactgacagaaagatgagatccactaaaccactgtagatgccatatattatgtgaaagataaagtatgtaagatatcaactcatgcttcactttttaaaaccactctaaagtaccttacattaagtgtacaacaaattttctaaataaactaaggatcagtaggatagtctctttatagttcttagacaatcaacaatagttatagttttcctgtaaggaaaataatttttaccttaccaatttcttttcaagtttgatgtttatcaaccacactcaaaaggaaaatttgtggttgtaacatttttattgcttctattgatcagtttcctgtaatcgttccttctttgattaaaaaaactcttctgacagttttgctaaatcctttaatttatattttatgaaaatatatctaaatatgttatttagttacattaacagttgcttacaacaaacttgacaaccaagacatttaagagaaagctctgtgaggaagtgcctatgtacctaacaaagaactctcattagaatctttgtccttaaaggaattctaaattttggggctgtgtttgttcttcacttttgccacttgatcttcaatggtatgtaaacagtctgtaataaagtgacactaatgctccttgaatgtcatgaaaaatctcattttagtttattatgtcatagggttagtgctcatgtatgtaagatgctaaacatctgaatatttgataacatttgaatgttatagcatcatattgttattgccaatgtgcatgctattttagaatctttatggatgcaacagcagcagaaagcaatatcaatatttagtatgcttgtaggtcattccaatttcagtaaaggagaagaacataatataccaggctaaggataccactaccacaggaccgctgactgtttagggacagaaatagggacctcaagaccacttaataaagattaaagggcctgattttcttaggtacagcagtatctaaacttctctatacatatatatgagaatgtttcgaatagatgctaatcaaatagatttgatcagtgagtgggtttttgagggtcagttaagaaagttatttgacccaacatgtagtgaaaggaagtattgtataatgttttaaaaacatgggatctggggtcagattttctggatttgtatcctgattgtgccacttaagtatctcaggcatgtgacctctcaattttttcatctgcaatgtgggcacaatgatactctttgacctatgggatagttgtgaaagttaactgagtttgtcaatgtaagaggttcctagaacctgttacataataagtcatccacaattttgcatttatatttatcactgttattagttacttgagtctaatggctctttgtcctggagtaattttgagacaataaccagcatattgaagaaatttcaattgattcattttctttcttaaacaatcattattttttattgctctattctactattaagaaaatagtattgctgtataatctctgattagaatcacactcctcttaaaatatgggctatcagttaagaagcaaaaggttggtacagatccatgttccacattactcttttagccagttacccagcaaccagatgcaaacaatttataaattaaaccccaccttttgtcagaagatttgaggcaatttgtaaagttaatatgcattgctgagatcgaggtgagagatcagaaaccaatcaggagaggaataaagataacgatcccaagaatctaagatgcgaaactgaattcagttgaataataaagatcagattttcctggcatctgaggccaaataaacaaatacccaaaacctatgatagtatttatattaatttgcagagaaccttatttcttaaagaaaaaaatccccccctttttttttgcagtcagatcttgattggttaagccaattcaaagggacccttaatttactgggggctttgttacacacatagctaatagcatgactaagaaaataaccagacaaatttaaaaagctatttccaggcatttgcagacacgtgggcacatattcagcagggtttcacaaatcttctgtgtctataatcaatagttaaaactaactctgcaaaatgtgcgcataaacaagatttccttttcatcttccttcccacttttttccttctctctctctctgtatgtgtcttctttctctctctgctgtttgtttgcttgctagtatccatcccttgcatccctggattgcccaggcctgtcacctgaggaaccctacctgattgaccaagctggctgatgtatcctactgttctcttctctatcttctctataaagcagcaaataactctagcattttagaaaacttttcagcaaaaaatagggcaaaaagtgtgttttagatgcctcttggttaagttaaacctttagtcaaatagaattttccattaactgataagtcctttaccagcacagtcagtataataagaataaagtgccatctgatgggattttctggggtagtgagactattcttcatgttgattgtggtggtgattatgtgactgcatgtgtttgtcaaaactcatagaaatgcacactaaaatgggcaaattttactgatgtaaattgtacctcagtaaacctgaccaaaaaaaatgtgtaccatctccagtttttttttttttttacttttttctattataaagggagagacttgaaagatatgtggatggatgaatggatagataaccaaaatgctatagagatagaattgtgtagttatagaaaagcactgagacttagaccccagaggtataatttcaggctcacttatactgccagctgtactctcttctcaaagtgtcaccagtaaggttactttccctttctggaatttgtttctgcctctataaactgaaagcattgcactagtatctgattaagctcaggcaattcctctggtgaggtggcctgatttgggggaagggtaggagggggaagtaggcagatttgcttgagtgtcagaaaataaatcatctatcacaaaaacaggtggaatggataatgtcatgtgaaatttgagaaacatctgttcgcctatattagtgtctgggtcaagatggagccacctgggttgaagtgatgtatcaggttgccaaaatcagtgtctagttgacccaagatgatttggccagtgtaaaacaagactgttatcagttttacagtttttagggttttttcactttctttaatttctggggaattgttattttttggagctagctggggaagagggaaagttaattaataaagttaatctcagtgtaagagaatatactcaccttaaaagagtaaagattgccttctaagaagagtaggtattattttctaaatattttactgtcttgctttactgtaattgcttgctcaaatagatctctttcagttagataaaagagaaaaaacctggatcattgattgcataaatacagaatggggaagagtaatttgtttagtaatattgatatgtgctttataacataacctgattatgtttgggggagctgaatttccacttccaagcacaaacagacctatatagaatagtaaaattgctaagatgatgattttgaaagagaaataataagagccaaggtaaaccatgttctatgatggaccttggttgttttcatcctgcaaggagcatcaataaatgaaacctgccagataaggttctccagtgataaactagactactcttatgccaatgacttgccaaattattgtatatagccagtatctgcatgattttatgattcataacccaaaaagggtgtgtttaacataatatgctgcttgaacctagaaatcagcagcagctgagaaatctacatttcagaaatacactggaatatgttcctcaacagagtgtgtggaagccaggcttttaatatattaatacaatgcttttggaaaatatatcacagctatccccagtgagagatgactgctttttagtgttcacttaatagccacacataaatagaattctttgcactaccttatgcaatgcctcctcaatcacatgtgtattggggcagggagagaaaggggtgcagaagccttttgaggaggcagatgtgcagttggggtctcttgccatacagaaagcttgaaaagaataataaaaccagtcaatggtaattttgtaatagcttagatgaccctgaaccccttgaaggtgaagtccttgacttaatttgtttttgaagctctcacccagtaccttgccttaaatgaagtatctctgtttggctttgtatttttttattgcttgctatgtgtcgggcactatgctacttctttcttgtaggttatctgttctaatctctaaaacaatcctgtgagggaaggtatcattattccccttttacagttgagaggtcaagtaacttgccttatagtcacagagttagctaatgataaacagctggaattcaaagacaaaaatgcttttttaccataccagagcttgcttcagtgtccagagattgaccatgcattaatttgtacctttaatatatgagtattattattaaaatgtatcttttcaaaaaattttttaagactagaggaaattcatatttaacatctccacagtcattatttaacttattttcatttaaaaataacagctttattaagatatcatttatataaccatcaccttttaaagtatacagctcagtagtttttagtgtatacaaaaacagtgcaaccatgataactatttgattccagaacattttcattacccacaaaggaaaccctctaaccattagcagtcatcccccaggccccctgcccccagccactggcaaccattaatttattctatggcatattctggacatttcacataaatggaatcatacaatgtgtgacattttatgacaaactactttctcttaacatatattaggttggtgcaaaagtaattgccattacttttattggcaaaaactgcaattacttttgcaccaacctaatagttttcagtttattcatgtcgtagtatgaatcaggacattattttttcttatagctaaataatattccattgttattgatataccacattttgcttatccattcattcatcagttttgatggacatttaggttgtttcagcttttgtggctattattaataatgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaacaactaataatgctgaacatctcagttgcttattgggcatttatgtcttccttggataaatccattcagatcatttgtcagtagaaatccctgataagatatatgatttaaaaatattttctcccactctgtgggttgtcttttcactttaattttgatgatgtccagtttatctgttttctttggttatttgggcctttaatatcatatataagaaatcattacctaatccaatgtcacaaagatttactgctatgttttcttttaggagttttatagctttacgtcttacagttaggtagctgatccattttgaggtaatttccgtgtgtggtagaagggaggggcacactttattttgttttgcagtttgccccagctccatttgttaaaagacttaatctttatccattgaattgtcttgacattcttgttaaagattaattgcccataaatataaatgtaagggtttatttaatatattttcatcaaattatgaaaggttaatattgttaattgtgcttaccatgaatttgatttaaatttttgaatttcagctgggcacggtggctcatgcctgtaatcccagcactttgggaggccaaggcgggcagatcatgaggtcaggagtttgagaccagcctgaccaacatgataaaaccccatctctaccaaaaatacaaaaaaaaaaattagccgggcgtggtggcacgcgcctgtaatcccagctaatcaggaggctgagacgggagaatcacttgaacctgggaggcagaggttgcagtgagccgagattgcgccactgcactccagcctgtgcggcacagcaagactcttatctatctatctattgatctatctatctatctatctatctatctatttatctatatctgagtttcacataaaacaagatggtgataagatacaaattgtgcttagttgctgtaaaacagttattgaaataattttgtcatcaaggaagcaacagtgaatggtttattactttgaaaataaatataattgagtctttatcataataaattagtattctctactacagcctaactttaactgtgaactagattactcaagagctagttttgaataaggtaatatataaatgtcatcattcattggctgccttagatgaaatctaagaatttttttacttgttagccactaaaatttccaatgagaaaaaaaaaagccagccaggaagttatcctacacaaattaaagctaatcataagacattttgaaaaataaaaataataggaaagtcatcatccatttccaaaatgaagaaatacattttcaggtctctgaagttctttcttcctcatgattttattttggttgagattatccagagatttccttcaaataatagcaatggacaacaaaatattttggtactatgatatggaccatttgatgtacaaactatatagagaatatattggttttgaaatgggtgtgtttgtgactttaactttccaaagtcaatatttaccatggatgcaattagtggctgatgttaaaactaaggtgacggggcttgtgcttattgtgctcttaatggtctcagcaagttgattaaatttgtttccagtgggcaatacacttgaggcaaagaggccctgcatagagtttagcaaatttatactttaacaattcttaaatattccatatcatgagtggctggtttgagaattaagattttagtcactaaaaagttagaaagtagcaagagaagttatgtactatttatcttctagacaggcctgagagaaacaaaaaacaatattgtataaatggtggacaaggaataatacttaagctgtgggatggtatggtatatgatttttatgaaacctcagcccaggcttttgcaccaaattgattgcattttctgaaacgcaagaagtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttctctcagcttaacaacactaatgcctgcaaactttcctagaaagattcattttccattactttaatcatttctgttattctctgtagaagagtattcttctcttttaaaggtaataatgctcagattgacttaagtggagtttcttcaggagattttgcactttttatacattttgtataagagaaggagcctgacaatctcagaattctatctaagagacttccatttcttacactgacatttctcagactgtcatttcccatcatcttatgtggtaatttatgaaaattctataagcaaggcttatgccaaagcagttcccaaaggcttttgctgttggagtcagtttggccatcaactcatgggaatgacttgtttaagtcactttttgtaagaggataatcttccaagctttatcttatccaaagcaattcagttgcatgaaaataataaaaagttgtaattcagatggagacataaaaatttgatttaaaagacctttttctattgctatgactttatttggaatgtataatgcagagatatgctgagtttaactcatataatgagaggcagagtgtacacttgtaaatcttcatagaaaggatttcacagctctcagtgctgcttagtatcaaaaatctaaatgagataccaactaaacacagatatttggcctgcaatattgtatagtacatctagttaccctgaaaacatagggagaggtcttgagatatctgtgggctacttcactattacaacttgccaattctgtaaatggactcactctatttattaggaaaatctctccctcttgtttgagctggaaatttctaaatcttttaaaataaaaaaaattaatgaacaaactctgaaataatcaaatgcaccaagtagaggaagaaatcagatctttccagaaaatcactgtttgttttaactggtagcaaagatggatcaaattgtaaagttaaattaatatatacatcttaagtaaaacacatacacatacacacacacacacagacacgcacacatatgtatggttctcaatacttgaataattttatgatttaatttggtgattaaacttgtcaggagagaaaaactagtttccctttggctttctgtaaggcaagacttggtcatgtcccagttaatttgggagaatataactaggtaatttagggtgtctgaattttgcagagacaataggtaaacttcacagagtttaggcaaaaaggattaatcagatgaattttcaggggaataaacttttctcttctctctcctctcccttctctccccttttctctttttatcccaccccaacagtttgggctggaagcagcttacagcaaatcagcaccttagcactcttaatatcacccagtgaaaagcagggttctattcttctagccatatacacaactctttatgccccccttcaggctcctgttggggattgtattttcccttcactattgcctttgatgtttattttaaactgtgaatctctcctgcatttaaatacttgttgcaccccttagcagctgctgaaacgtattgcaggggttccactctgatgagacaattataaaacaatctcactatctcctaagcccgcacctggggtggtgggttggggatagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagcaaaaaaaaaaaaaacataaaagtcagtacacttttttcatggatcggttttaatctctgttatgaattctcaaataagtgttttttcttaccttaaatttatttttattagtgatagaggaggtttatttcataaatgaaattaaaaatctattagaatatcagaacttctgtgcatatatgcctaaaatataccctaaaactaagtgaagctaaattgatagaattacaaaagacattgatacttccataatcacagactggaggactttaacatctgcctcggaatgttatagatcaagttggcaaaaacctccataagaatgcaattagcaagcttggacccatggaaatatattgaattctgaatcaagagttagagaataaactaaaaaataatcaaggttagaaaataaaatgtttcttatgtgctgtattcttttccagcacgtaagggacattttgaaaaattgattataatcttggctgtagagaaaatcttaaataccaaagaatccgtatcctatagaacatattctctgaccaaaattcaatacaatttagaaaggaacaacaaaatgataaccaaaaatccttaagtgtttagaagttgaacacatacatgtctgagtgatttataggaaaaggaaaatgttaatgtgaactcaaaaaatgtatttactttattggatatttatctaatgcattaatacttttgattaaagaggaaaatagtttttggggcctctcacacatatcaaatgataagattaaacaaatagcataataattcataaatatttgtgggggctttttaaaaagtgttgttgagcaaattaatataatagacaaaattgtaaaaagattatttaatctatttaggacaacatttttttttcaagttctttggtagccctagattttctatcacacacttcctaacacagtgtgttgcagacaggcattcagtgaatttttgttgaattggttgcagtagaggatagtgaaaacatataccttggtatagtcttgatgagttaattaaaaattattcttgctcaatcaatatactaggttctctaaggttctctgttaggcagcctggatgaatatattgaagttgcttcaatttagattttaaattaattcagattgaccttcctgataatactgctaaataaacgaagcataacgtaattggttaatcttttcaaaaagacaaagtaaatctcaaagccacatcccacagatactctcttgcctcggtcagatgtgggtgaagtatcttctctggactctataatctgtcatctaagccagatggggatacatggtttttgaaactgattagccagggtgaacttgctaaggttatagatagaccatctaaatttacttctaattccagactaagaattaggtcccagttcctgacttatacaagcccaaagtgaaaataaatttcatcaaacatatttttatcttttaataagtttgagcattgtccgagtaacacataaatggttaaaataatatttagactgcatttgtgcctgcatttgaattcacagagatatttataggtgaagctctctcttcccttttgcataaacattaaaataattcaatcagcttgttataccagatattttcgttatatctcccaaatattagcagtttgttccataggatttaatcatggttccatccagaggcttattattatagcagtaatttatggcaatgaaatcaatttgaaaacatacagaacctaagaactaacaaaatgtagttgttatgtgtgaattaaaatataaactgagaatttgaaaatattcaaataactagaatctctctaatttggtagactgctgacctggatttgtgaaacattttcaataggaaaatcttaaatatcattctaatactttcaaagaccttgtaattttcacttgtactcttactgtgaaaattgccacattgtctcttgcattgtggaggtttgtgtaactttattatctatattaaaaattccttaaaaataaaaactataactaatttttatatttccttgctttctacatatcatataggtagtatttaataaatacttacatatgcaggtagtgtgaaagggttaaagagcaccagggtcttgggcttagtcttgcctctgctactacctctatgcctttggacagtgggaatcaatgaatttggaaaattagtggtggagaattcagcagaaaaaaatggtgaaactatttgaaggaggaaagaaaaaagtcaaagttgtgagcaaggtaaagttggtttctacgtgcttccatgatcctttagatcgctttccttcctttcctccaaatctgggaattgtcattgctacacatacacactgctccctccacgtactcctcctacatgcatgcatacacatatacacacatttattgaaacaaccagataattgttataaatatgtagttttatctagacgattgccttagtcttccatattgcctcgctagatttcacttgcctacctcagtgacttttatgtttgggtagccttaactcaaatcttcctgtagttggattctattattctgtgcaatagtaccattctacttttatcatgttgcatttttcagcttggcattctttgagtggctatatccaccatactttccccccatccacttcccccgccccccaccactctgttcgccacacaactgtaagggatatattgaggggtttaactctgagactttcagttgatttcacactcttcatatttcatttctgcaggctttaggtaaacagcatgtcataggcaaatccagcattatagtagccaaaatgttctgaaattccgactgccttggtaattccttagagttaaaaaacactctcaaaaaagcattaaatttaaaaactcaagttcgtaattaaaaaaaacacacacacacacagccccagttaaaatgcacatgttgtaccatgatgagaaaagaggtcactggataagatctttgcaatacattagtatgggaagattagctagtgctttggctttgcaaaggccaaagccagatgctgaaggaatgggacagcagggtggaatgttgaggaagggaatgtgtgaggcatggagtttacccataaaggtcaattcaaggcaacagtctacatgtaaaagtagttttcagtcaacttaggggctacaatgaggactcataccttttgagggtggcagggcctggaagttagaggtaaattgatattgatagaagatgtccttttgttctctcatgtctatgtttaaaagcattgactagaccctaagggccttgtactatcttaaatgtaaactatgcttttttcctcatcatcatctttctccagtctttttctactccctgctgcttctctcattttctcttctattctttccttttctattttccctcctccttggcatttcccttattcttagtagccatcccagtcaacttcagtgcttctaaagtgcctttgagtactactagttactgctatggtttgcagagacaattcagtttataaagactttttaaaaaatgcatcaacatcctcttcacctcatctttatattaagggctgttgtgtttgtacctctgtggacacacctggaaaagttgagaattccattttgactgtgtagattttaagacaaagttgcttcttttggttgaacccctcttctcagtcatcacccatctgtctcagtgcttttctttcaactagttgtgctgtttgatagaattggaaacactgcagcttacatctgtctgagcagatggaatgcattttgcatgagtgttaactgattcatgcattacataaagaaagcaatctgtgttaaaacattgtgacattgcaataaagcactatctgctgtatgctgaaacctgtttgcttacggagggttttgttgctcttgccataccctcacccactgccccatggttaagcccagacaaaccttaaaaggaaaaggtatacaatctaccatagtgggagaaaatagtaactgaaagaaaaaaaatcctgaatatgtaagtcattccaatagatgagttcttttttatttttgtagtgtattgtcattcggagggaaaaaaagagaatgtcattgtggggaagcttcttacatggagaactaaatagtcatcaatcacttgatcatgctttccatatactttggtaaacaatgctgcttggaagtgttatcagagggtttgaaatagtgtgggccctagtctcatggagttcctatgtagtttcctcagcatgtgcagttatagcctgtgactttaaatttgaattagtgaccagcattgaaggttttatggtgtcacccatttgtaacagcaagcttcaatggctttgtacttttgtcccctgtagatctggcttgccacatagcagtatgttgcagtctttccttagttgcctactagtagctattcatttatttcctgcaaatgttgtatgtatcccacagccaagaacacagaactttattgtccattttgtacaattcgtcatttgagtgctatagcgtaatagagagcagctctatgtgcaaatgatgttactatgtattttgacctattgtttccctgcaggagtaataacaagggcaataaaactcagtcaaagctgctgtataagcacacataactgcctcaaattacagggcactttcaaagctacaaagccactgaaactacgaaggctgtcttctgactcctttcacagttctaataagcatgaccatgactgtcccagatttctggaaggggaaaaacattattctgttggattattctggtgattctgtagctttttagctacaaaaatctgtttccatacaaatcctttgactacatgtagcaaaggtttgggtaatttaggggtatgttaagaaaaaaaaatgtagaagtaaagaacttagagctagctctcactatcacatgtccccatagttgatataactacagagggtatcaactgcaagtatttagtgaagatttcagagtagtagccacaggttaggggaagcatggatgaacattaagtaatgttacctgacaaacttttgtcaatttggcaagagccttggcacttcgattattttgtgagctcatgccctctgaccgtgactagcttcttcattgaggccctctgactgaatagagttgtgaaaaattttgggtggcatcacagtgcaacctagggtcaatgaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatcttaaagtgtcaaggttaaaatagtatttattcaactccaggatccatctgctgaaagtcagaaatatcgactcctgccagttctgagttttctccaaaaggaaaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaatttaagtctcaggtgaccaagacactgacaattcataactcttctttacaattattgggtaacctgtatttgattctgggtccccagtgtaaaaattgaccttgcttcattacttttgagatacaactaaatttggggaatttggtgtcgcatgaatgcaagtccttttgtaaagtagaaatgttttatgactgttcctttatttgctttgttatgtttaacaagattttcctgcattggtttttgttaaaagcaggcacatatacctcttaacaatgccctgtatgtgagcagtatcttaaattcagggacatgcaacatattcttttcgtaggacagatttgaaatgctaatattaattttagagtcatgaagaacaacagcaccgtaataaactaggtttttcccaggggaagtggactaaatgatgctgcttatttgattatctaagttaattaattaagaacacaaatccttgccaaactgaaatcaacacattaagggatatgtattctccctggatagtttgaaatgatactgcaaaaagaatatacgttcatcttaattactatattttggaatgcaaccccagaaaacagatttagttgtgtcagcataaattaatcagggaagttttttaggactttatttaagtccttcacatggtagcatatattttttctctagaactgtttaaacatactgtatttgagatccaataatttatgttaataactagcctttgcatttggttctattctctaattgtttctggtgtatacatcttacaaactataaatttctccaataaactgtgaatagaacagtttatctttccaactctccatcctcttcccctttttaaaacttcattcactttttgaaattccctgctcactcatggtctcatggtttccctgctctccattccagaaacctgcttctttcaatatggctgaagaacaaccccttctggaactcctcaggctccagccttttctttactccaccttctcattccatcagtacttaactgttcattgccactgttttagttacctcatctgatagtctaactcatgcttaaatgttagtgacaaattaatgtgtccttctcttagctaatattgagtttcattatcttaataacatggaggacaggacttaataaataatttttataccttgttgtaggttgtggagtacccggaagtattttgaatagttgacctattgccccccaaatcaataactgaattattatttattattattattattattaactaaacttgaatgcgtggaatgagtttgacaacaagacaaagagttttcttaagtgaagatgatagacttcttgattctaaatgccaatagacttgaatctagagtcaagaatgactacaaagcattgttactacctattgtcttctgttcctcaaatacgaaagagcctatgaacttatacaaagtatttaagcagcagttgcttttacgataagaatgagagctaagagaatttttttctcctagctctgtgatgcttgaaaattatttaaaaagaaagaaatgctgtcatttgtgacaacatggaagaacctggaagacattatgttaagtaagataagacagacatagaaagacaaataatggatgatctcacatatctggattctaaaaagttgaactcatagaagcagagagtataatagtggttaccagaggttggtggcagtgggggacaggggattggggagatattggtcaaaagacacaaaatttcagttagacagaagaataagttcaagagatctgttgcacatcatggtgattatagttaataacaatatattgttataaatatatttactaaaagagtaaattttaagtgttttcaccacagaaaaataataagcatgcagtgtaatgcatatgttaattagctcaatttagccattccacaatgtattcatatatcaaaccaccttgttataaaccataaatatatacaatttttatttatcaattaaaaatgtaaaggtcattctttgtactcaaactctagttaatgaagcattattaatcttgtggagctagtggctcctgtatgatactccagatattactgataggaaaaacagcccaaaaaatccacatttataatttactactgttcttgtgattttcctgaataatattcactgaggttaaaggcaattgtgagattatttaacactcaatgtagaatctaaaactaaatttctttcttaacgttctaaaactaaattcctttcttagtgttcttttgtgtgtttaacacaaatgttgttaacgtaatttgccataaaactcacattctaactgaaaaagggcacatcctaaaaactggattcataggttctagttcagcatctcatttatgacaagtccttcagctaagatcgcaaaacagcttctgtataatcaatgaaccacaagatggcaccactgaacaattagcttatctcaaggtggcttctaggttctctagataggtgcccaagaatagtgttatacttcttcaaaacgaacatcagtcacttaatcagtcacttctggtgaatagagtatgaaagggaaaaataacaactttatagtggagaaacctggcaggttgttaccttaaccaagtgctcaaggttaatatcaccattgatcaacatggagatatcatgtacccctgatatgatgtgatgaaaagggcatttcacttctgtgatatccttcccaaaaattcacataacctcaatctaatcataagaaaacatcagccaaacccaagttgagggatattctacaaaatacttgaccagtactctttaaaagtgtcacagttatgaaaaacaggaaagactgaggacttgtcacacactggagaagtttaagaagacatgatagctaaatagaatgtaggatccaggtttggttctagaaaaaggacattagtgagaaaactgggaagtcagaataagttttaaaatttagttaagagtattataccaatattaatttcttcattttgacaattgtagcatggccatctaagatgttaacattggaagaaactggggaaaggatatacaggaaccccctgtgctatctttgaaactgctctataagtctaaaattatttcaaaataaaatttttgaggagtcaaggtacagggggaactcttctgaaatgctctcttaacagtagcacatttctatgatctattgtctgtatatgccagacttctatggagtcttgtagaatgatttggcatattaactcagtacatggttccgagacctggagttttattcctctgtaggttcagtgagcatatttttcaaacccaatattaggacacattttctgacgaaataacttcattcaattttcaagtgtgaataaatcacagataatgagggtagaaccaagctgattttttttctgttttatggccatggttggaatcttttaatgacattcagttgtctcactaatatgtcataatctattgattttagacttcaaaaattttgtattttacttatcatcagttaaataatgtatggctaatatttttgataacctgataaatattttgtattgcccaaaataatagtggctcataaataatctcttagaatcaaggaaggaagcattgtaactttttaaagggatgcatgcaaatcagtttccaacatgttgtatttgtgcatacagatgtggaaaaaattttactagcaagtgttcgtgtgaataattatgaaaacaatgcttcctaagttataaggactgaataaataaaaatattaatatataattcctcccagagatgtaaataaatttgaagggtatccaacatactcaataatttttataaactcggttaagttcaggtgtcattacaatcctacgaaaaagaacagtttaaaactgttttattataactgtccagcaaaagtaatctgactccatccaaacaggctgccccaattaagacaagtgacagaagataacacaagctcatgttcttttgaaaaatttaaaagaagctaaggaggttgcaaaaatagtgctttttgtctgataaaagagaaaattgtttctagaacttgatagtattacttcatggattgatccttacaaactctgcctcatttccacttctcatgtaaatctgattttgcctttgcatttgtttcccaagactttaggttaaacagacaggtcttgatcttgggttcctacttttctctggatcaatcaataacctgtaactttttcctttcctttaaaaattctagtcttctgtggctggcatgctccgccctaaactgctcacccaattctggacatttccttgtgccttgattactagtctctgaaccctatcccaagtcaagcacattaccttgctcagtttccgtctttcctgccttgtgtactagtttcttaggtcagctgtaaaaaattgctacaaactggatggcttaaaacaaacaaaatgtattccctcacaattttggacataagaattctgagttgaggtgtctgttgggccattctctctctgaagtctctagggaggaaactgttccttgtctcttcctggcttctggtgttatcaacaatccttgacatttcttggcttgtagttgtatcactgcaatttcttcttgtcttttacatgactgtcacccctttctgtatccctgtgtctctgcgttcaaatctcccttcctttcgtcttataaagaaaccggacattgaccaaacaaatccatatgacctcatcatagtttgattacatctgcaaagaccctgtttccaaataaggtcacattttgaggttccaggtgaacctcaattttcgaggggacactgttcaaccaagtacagcccccagatcaaaccttctgctgagaaatatcagataaggcattctatttattactcatagtaatgttatactgattttttctatgactacagtttggaatatgtctagaaggtaccagccacaaaataggagatctgattccaaacctatgtgttcacctttaaaaattacaaatctgtagcttatacttgcatttagggtaagatctaagctcttataactcatcatattttcaataagagagaattttctagaacttattccttttataaatatttttggttcatatgattcaggacatattaaacagtttagaggctgttgaattaattatgaatcactcacactaagtgatcattatggagataatgcatggctaatatttttgctaacatgataaatattttgtgtttgaagaagagtccagtggaaagatgtctgcatagtatcacataatcaattgaaaaaatgtttagtacaacaactcgttttctgccatcttcaatagaaaattttcacttagattaaatgaaaattttcatttagattaaatgctttggtgccatgcaaacctagattaaagacactaagtaagcaataactttaaataggcaattatgtccactagttactacagatgtaaacagccaaactgttccataaccttcgtcgagtgttttgagtgggatggtgatttctttaaaatgttgataatttaatatttctgttttctatataatactatatatttcatttgtatatattttatattttataacatacaatgtattcgacactaattttaatattttctactttaattgcttcttgatagctggattacctagccagcatttgatatttatcactatcctgtatttcagggacttcatgagaagactggtgcatttacagctgttaaagtgatgaacgctcgtaaggtaatattataaattgcctgtattctcttcccttagtggactgtgttcctgggatacacaactcagaaaatattgtatttgtttttaaatcattattttatataataattattacatcaatctggatttattatagttatcatttaatattacttttattcattagtgtattatatctattactttattatatatccacataaaacaatgcttctttcacagcagaagttccacatattttggtattctataacactgaggaatatatctgtactcctctctgtttctagttgactatttgtttccagggatagcaaagaagagattgcttctaatattgggttaatcctgctgtgttccatcatattattttccctctccaatgatttcctctgataattgaggccattagattctcaatgacaggtagaaggaagagacttatcagaaatgcacatttttcatgtattttctgacagatgagcaaaagagacagtttaattggcaccgttcctggtaacattcataaagttgtgtcacggttcataacatattggcatagaatttgctagcactgatttctgttctttttctttaacgtgagtgccacactttctcaagataatattatcataaacatagaaaaggtcaaaaaaattttacttcactataccctaaagggaaatttgtgtttgaaaagctatacacattgactgaactgttgtcaaggccataaactgtgctttttccaatttgtgcaggaagtgaattgctgaaactgtttaaagagttgtgtgcttccatagcacatgtgtacctatgtaacaaatctgcacattctgcacatgtatcccagaacttaaagtataataataaaaaaagaaatgatagctgaattaaaaaaaaaagttgtgtgcttttagttttgccagtaaatgtcaaaagttgcaaaccaatgtgagtttcgagggattttgatgttttgtagatttattttgccctacaatccatggcttccaaataatcaaacttctactttttgagtgatactctctaaaatacttattttcttgttttaacttaagagaccttgacatacttttaacctacatttcagatactctgacttttaaaatatttaaaaatcatgttcaacccatggaagtttagtgtcaattaactggttttgtaaggaggataaagcactttactaataacaaattgtaattttcccattattacagcagttaaatctactaccatgaatttgttgccaaatttctgtatgtcataagaatttggttttttaaattaaaactattggagaaaattgagagaggaataatgttatcttacttttccattgagtgctaacgtagcttaaagtacttaagcataaatcatttttagagtgtaccagtacatctaataacattttattcttggttacagacccctttacctgaaataggaaggcgagtgagagtgaataaatatcaaaaatctgttgggtggagatacagtgtgagtactaaaagttctcattaatacccaagtagtctttcctttcattttcagcttttaacttatccctttgcattgtgtcattatctctagaagactgctactaaaagtgttcttgcctgaaagtgataacatatttatatcttttaatatattcacttagattcaatcatcatatatgagcactagcatatatcagagagtaggagataggagaaaagggcccttgaataggaatgcattgactgtcagtgaggaattgcgtaaatttacagagcatagaaccctctggctgaatagcaacaaaaaaggaggtgatgcgatctacagcaaattttgcctaaaattggccttggaaaggtccttttcacacgtttatcatgacattctggactaattgcttttcctccattgtgattctaacaaacattaccatcgtgtttgaaccaaatgaggaatgccccacgtgcccacccccccgctttttgtaagagcaatagcaggcagaaaacaaaccaaccacttagcctcaaggtcttcagacatctggtaccatacttgaacacatgaaaggatatgaacatgttttctatgtgcagctttttggcttaccttcagagcagtttttctgataccaacaattctctggctccagaataaaaccaaccaaagataatctctctttttcagtagatattggtgatctataaaatattgtatgggcccaaaagttgaatttttgctcttatcaatataatgaattgatatattttttcctacttttctctcctgcagtcagctatacatgagactcaaatatttctagcattttgtgacttagtaaatatgtctcaggcacattaaaaataacccttttactaacacaatcacattcagaaactttctagttatattagaaagatattactaaacaacctcatgactcatctattaagtactaggctcctgttatgtctataattcatgttaggagactaagcatatccagaggaccagctaaaacagatagtatcatgcttttgtagcttaggaaaccgcaaaagataaggtatggaaaatatgattattttattaattttggtttcatcaaacatttgtgctaataaaacttttttaaagacctgtcccaaaccctctctggcacactttccttagagaaaaggattttgattctagaattggatgaaattacaaaggaagttctggcatccttgagctgcctcctcttgacaaaacgcagggtattcaggccagtctgtgatcaactggccctaagccaggaaatgctgtagcatcatattactggaagatgtgtgagagttttaaattacccacttggtctgatggatataatgtacttatgtgtttctcacaagctcagcttcctgttaattcagagtggcaaacacactaacgcttcccaaacatatctgatcttcatttatttgttttgggggagtttacatttatgtgggcaacccactcttaaaaggtttttctagttggggactttgaattatctgattatgtattttagtaagaaaaaataactgctagctaatcatccagttagtatctctaaattatcttgaatcctttaggataaaaagtatgtgacttgcacacacatctcttagatgccaggggtttatggaaatagcaataatatgtaagtccagaaacatgagttcaaatcccaagtctaccactaaatagccaaaaagtgcttgggaaagtggtttacctttctatgtctcaggttcctcatagaaaaagagacatcacaaatgcaactacatagctgcccagagcccagcgcatctcttgttctttccaggacacataagctttctaactcaaaaagaaaaggaatcaccttaacatcaagctaccaaactagtgaaataattcagtcttgcccctgcttctctttcacttgttctttgtattcttaacctcctaccatcctctcattcctatttattgcactacttatgagttcatattcctctcagcagaaccttggcaacttaattgaaactgagagtgcgtacgcacaaatattctataatagctagtccctgtggtttgctagtcttatgcggtgccaggtattgttactatttcaaaggagggccacatcacaggggaagcagaaagtttaaggatcttacatgacaagaattaaagccacaggatttttacctttctagaaaacagattaagataatttgaagggaacttattaactgaactttgctgggaggttgggatgagactctagcctgagctttcatgcaattctcataccacaagttgtcatgactttattacacaaataaatagaaagagggaacctatcactgagattttcaactgcacatatcaggacctatccttttcccccataagacaaataggtgtctagagatttattttccagtagttgaatgtttataggtaaatccagtggaaaatccttgggaaatactaaagaatgttctgcaactgccagccattttctctgacattgcaaactttttttttttttacgagatataaataccgggcattttaggggaggaaagataatttataactaaaagttaagtcaacttagagacactacagagcctagtgcactgctttatatttatgtcataagtatttttaaagcctagccacattatacctaaatatagaaagtagttgcctatttttcctgctggttcttagagaattagctaagagagaaggtaataactgagttatgtttagttaccaattcatttcagctaagagacttatttccctatatttcagtcattaagtcaggatagtttgaggaaaatgctggggagaactaaagaaaattggtggttaatcccttaattattttccatgtcaattgtccctttcctaggtcattgctcaaaagagttaaggaaatcttttttttcactggatttcagaaccggaagtctttaattcaaaagttttttgtttgtttgtttgtttgtttttgagacaaggtctcactctgttgcccaggctagtgtgcagtggcacaatcttggcctcctgggttcaagtggttctcctgcctcagcctccccagtagttgggattataggcatctaccatcatgcttggctaatttttgtacttttagtagagatggggttccaccattttggccaggctggtctcaaactcctgacctcaagtgatccacctgccttagcctcccagagtgctggaattacaggtgtgagccaccacgccaggccaaaagtcttcttttctttacactctacaaatatatttcactttcaacaataagaatatttcttaataatttttataaattgaactattatagatgaaataggagagctttttaatttacaatcaaataaaatttagagctactatgaattcaaaggaggtcagtgaggaatccatttttcaagtacagaatcacttcctgagtcatctcacatcaccttcaactttattatgtattcaactattttgtattcaccgttggttgtgtcattcacatatgtgaatcttatttcctgatgtgtaatttcctttaagttaggatcataatacctaaatgcacaaaccaattatattttcattgaaaattttaacaatttaagttgtctttttgtaagttaacattttaagatatttttctcaagtgtattgcatctgtatacacaaaagtgtaattgttttcaaattattaagaagcaaagagttttttctagattggctgagaaataagagttacagaaggaatatcaaaaccacttggctatcatggtacaagcagacatcactgaaactttgagagaattgctttccatgtcactccactataattaatatgctgggaatgaaggaggctgatgtttgtagattacggtaaacagtggagggaagtgtatagttctgatagcgctcggagtaattcaaagaagtcaaataacaatgatattttgtgataatacattgcatttatagaatttttttcaaagatttcaaagaactttatatatgttatcccatttggtcccactaacattccatgaagataggtaatggctgctatcttccatcattcttttaaaataaattgaactttaggaagattaagtgaatttcctactctgggctatcagtgctaaacctcggtgtcctaatgcctatggtaggtgtttttttctgactgacatcacactgtcttctgctagagctgtcttgaagctatatattgtacctcggtgatctcatctaaccagatggctccaattatcactatatagataattctcagaaacaatacttctagacctgacttgtcccctgagtgccagacccatatatcctttctgtgcaatcttgtgcagccataagaaggaagtgcatttgtttattgatatggaaagatgtgctttatatactgattaaaacatgaaaattgcagaatattaaaaataataagagcttatttggattttttaaatgacacacacacacatatataaatgcataatgatatgatcaacacacacacatacacatacagacacacatgtatatatacataattatatattatatatacagataattatatatataattatattatatataatatattgataattatattatatatattacatattgataattatatatatatacgtgtgtgtgtatgtgtgtgtgtgtgttgatcatatcattatgcatttatctctgtcatagctctagctactgcattatcatatacaaatgtctgaaagaatatacactaaacagttaatattgcttggggaaaatgttcagtgagagtagaccccttacatattttattagtatatttctctatatttggtatgcatgtgccattgttgtgattaataaaaataaattatcgaaaaaaataaaaataaataaataaaatgtgaaaaaataataaaaatttttaaaagatcagcacagaacaaaccaatacctttaaaatgtaaaggattaccaaataatcaagatagtatggtactgtccatccacatgcaaaataatgaggttggacttttactttatataaaagttaactcaaaatggatcagacacctaagtataagagctaaaactataaaatgcttagaagaaaacaaggataaagctttgtgacctatgatttgacagtggatgcttatatatggcaccaaaagtacaagcaacaaaacaacaaatttataaattgtgcttcattaaaataaaaacttttgtgcttcaaaggtcactatcaagacagtgagaaaacaatccacagtatgagagaaattatttgcaagttgtctatctgataaggcacttgtatctagaatatatgaagagctcttacaattcagtaataaaatgacaacccagtttttaaaaggacaaagaattttgtattagacatttcttgaagaacatatcggcaataggcacaggaaaagatgctcaacatcattagtcatcagggaattgcaaattaaaaccacaatgagacaccacttcacacccactagaatggttataataataaaacagaaaatagcaagtgttggtgatagtgtagagaaagtggaacccctgcatacattgctcttggtaatgcaaaatggtaaagccaatgtgggagacagtctgtcatttcatcaaaacattaaacatagagttacttgacatgactgttcatagaagcattattcataatagctaaatggtagaaatagcccaaacatccctcaattgatgaatggtaaaccaaaagcaatgaaacattgttacatgctacatatggatgaactttgaaaagaactagtcacaaaagaccatgttatatgatttcatttatataaaatgtccagaactgataaatctactgagacataaagtggattagtgattgcttagagttggggtgtgtgtgtggcagaattgggggatgataactaaaggatatggggtttccttttggagtgataaaaatgttctaaaattgattgtggtgatgattgcacaactgtataaatatactaaaaaccattgcattttgcactttaaatgggtgaattttatagtatgtgaattatatctcaataaaactgttacaaaagaaacaacaatataatgactccactcagtgaaaattttatacagtggccagtgccgctggtccagggaccataccttaagaaccactgaactaaacgatcttcagtttaccctttttattcccccagactccaggttaaccagaggtcttcattcactgaccattttagttgagattttattataaattgctgttggatataattagttgccataggattctccttcattgatatactgtactttagggacttatagtcattgattgcacagtttaggagctttgctgtctattcttattccataggatgaggaagaggatctcaggactgaactcaaccttctgaggaagtactctttccacaaaaacattgtgtccttctatggagcatttttcaagctgagtccccctggtcagcggcaccaactttgggtatgtttttaattacactgttcttattctataagaataagttttacccaaggatgtatgttttcatgagttatcacttttgtgcatctacaggaaaacttagcacacaactgttaaggtagtatggtgtattaatctggtctcacaatgctattaggttggcgcaaaataatcgtggtttttgccattagacatacccgagactaggtaatttataaaggaaagagttttcattgactcacagttccacatggctgaggagacctcacaatcacggcagaaggcaaaggaggagcaaagtcacgtcttgcatggcggcaggcaagagagcatgttcagggaaattccccattataaaaccatcagatctcgtgaacttattcactgccatgagaacagcgtgggaaagaccggcccccatgattcagttacctcccacgacatgtgggaattatgggagctacaattcaagatatttgggtgtggacacagagccaaaccatatcatttcatcactggcccctcccaaatctcatctcctcaggtttcagaaccaatcatgccttcccagcagttccccaaagtcttaactcatttcagcattaactcaaaagtctgccgtacaaattctcatctgagacaaggcaagtcccttccatctatgaacctgtaaaatcaaaagcaagttagttaccgtagatacaatgtgggtataggcattgggtaaatatgcctgctccaaatgggagaaattggcccaaacgcaggggctacaagccccatgcaagtccaaaatccagcagagcagtcaaatcttaaagttccaaaatgatctcctttgactccatatctcacatccaggtcatgcagatgcaagaggtgggttcccatggtcttggccaactctgcctctgtggctttgcagcgtacagctccctcctggctgctttcacgggttgacattgagtgtctgtggcttttccaggcacatggtgcaggctgttggtggacctgccattcagggttctggaggacagtggccctcttctcacagctgcaccaggcagtgccccagtggtgactctgtgtgggagcttcaaccccgcatttcccttctacactgccctaacagaggttctccacgaggacctggccactgcagcaaacttcggcctggacattcaggagtttccatacatcttctgaaatctaggcagaggctcccaaacctcaagtcttgatttctgtgcatcagcaggctcaacaccatgtgtaagctgccaagacttggggcttgcaccctctgaaacaacagcccaagctgtaccttggccccttttagccacagctggagtggctgggacacagggcaacaagtccctaggctgcacacagcaagaggaccctgggcctggcccatgaaaccattttttttcctcctaggcctctgggcctgtgatggcaggggctgctgtgaagatctctgacatgctctggagacatttccccattgtcttggtgattaacgtttggctccttgttacttttgcaaatttctgcatttggcttgaatttctcctcagaaaacgggtttttcttttctattgcataatcaggctgcaaattttccaaacttttatgctctgcttcctcttgaaccctttgctacttagagatttcttccagaagataccctaaattatctctctcaagttcaaagttccacatatctctagggaaggggcaaaattccgccagtctctttgcttaaacataacaaaggtcaccttcgctccagttcccaacaaatttctcatctccatctgagactatctcagcctgaaccatattgtccgtatcattatcagcactttggtcaaggtcattcaacaagtttctaggaagttccaaactttcccacatcttcctgtccttctgagccctccaaactatttcaacctttggctgttacccagttccaaagttgcttccatattttcaggtatctttacagcagtgccccactctactgacactaatttattgtattagtctgttctcacgctgctcgtaaagacatacctgagccttaataatttataaaggaaatttataaaggaaagaggtttaattgacacagttccacatggttagggagggctcacaatcatggtggaaagcaaaggaggagcaaagtcatgtcctgcatggtggcaggcaagacagcatgtgcaagggcattcccctttataaaaccattaatctcaaatctcgtgacacttattcactatcactagaagagcacgggaaagacctgcccccatgattcaattacctcccaccaggtccctcccatgacatgtgggaattatgggagctacaattcaagatgagatttgggtgagaaacagccaaaccatatcatgtggcaaaatatactatgattcctggagatgacagtgataaaatatgggaaaataacttaagtgcctggcaaggggattactggtgggatgggggaggactcaaatgaatactggaaatagtcaacataaatattttcaaatattttatgtaattactatggttgctattacagaaattacccaatgaactaataaataatgactggataaggataaattctaattagcacttgacatgagcatatgggtgcattttaagtttttgcaaagtatatgcgcttatggataaacataactcctaagaaactcttttccaaatggtaagttgacttatccttttcttagtcattatgcctggtgtatcacaaattctagatcaataagatataaattgtagaggataaatggaacctatgctacctaagtcacagttaccagaatttttgctgccctccactgtggtaaaaatagttaaatcacaagaaaatcagttttggtcaaggatgtctttattaaaaattgaatatttagaatataaggtggggttagtatacacttgaatctctatacttgctgcatttccattccatgtccaagttagtagtattttttcaaaataatgactaaagcttttcagtatcttcaagtggcaataaagtattctattacattctaaataatggacttcagaaaataggacagtggacattatagaaaggttttcaacaaggggtggaattgaaacagtggttctctaaatttggcagccatcagaatctcccagagagcctgataaaacacctatttctgggcgtcactcacagaatttctgattcagtagatttgggggtgtgggtccaaaaaattatccttcctaataagttcatatgtgatgctgctgctactgctggactgatcaccacactttgagaaccaccaaatttatagaccttcagcttaactctgttttctctcagatgtccagttaacatgcatcctctattctctgacaattccagttgagattttagtaaatatggctgcatagtttagttactgaggaattttttttggcatataccatttgtcttttttatatattttcacttacaagtttttttttcctcttgatagtatagcaaagtgtgagaaattttgcagtctccttactggatatgtattagtactcagttcattcaggcattcaacatatatcaattgaaaactatctatttgtcaggtgttgtgctagatgctgaggataaaatggtaagctgaatagacatgctcctgacccagtggtgcttacaatctatttgcaaagaccagcgtcaatcaaataatcacacacataaatgtataattggtcagaagagaaatatcatggctgtctgtgggtgaataacaaaccttaattaagctgggaaatgagaaaaacttccttgaggaataaaagcttgaactgagatctgaaggatgaataaacatttaatgcataaattatttgtgaagataagaattttcatgggacacttcacaaattttggcctatataaatcagaaaaacaaataggaagtaagtaaatagcttaataatgaccattaataaagaagtgtacgtaccaggcaccatgcttacaaagttaggaaaattactgagaatgtcttacattccttttatagttgagctcttctgactcacataatataagcaagatcttccagggtttatgttagttgaatggctttaattctggtttgtcatggttgaaaatgaggagttaccacagtgtacatgttgtgcccattcaatatagtcaatgcttaattctccacgtgaaaatcaactttttgtggcttatctgttttcgttttgtttggctgtctcttcttctttttggtgaaagtgtactcaggtgaaagacatgcaataatatcaatggtgaataaccgtaaattaggggagtagttttctgaaaagaagatcttaatattccacaggaagtaaggtagactttttgaatagtcatgattttgagtttatccttttgcttccattcatctatggtgataattaatttgcacaaagttaaaaaaagacattttgctcttttgataaagtatttttgaagtgggcagtaatacataaacctgtactcaaagaaaatattgctaggataattataatagttatatgctcttgtacatcactctttagttaactcatattacctggatgaaaatttactagttgggccctcaatttatatgtgtcaaaaataaactttctgagaaactgagtttattaatacaataaaatctgaatgaaatattattgaagatattagttttaaaataggttttccttagtagcaatcccatttggatgaaattatcccacaggaatgcaattgacaaattccaccttggagttgtagcttgccagtatcttgaagaaaatagtttggaatttgaaaataaaaacaaaacaacaaaaaccaaacctagccttaatgttgaaatgtaaactcttttgagaccctccatattttgcttcttcacccctgattaaactgtttccttgaccatcctttccttcccattccagtcgtcacttaggtttgttccttgcacaaacttctttctaaaagcatgtgtttatttagttttccataaatggaatgttcttccttttaagcatatacaaacaccacctatccttcaagacatagctcaaaccccaacttccagttaaatatctctggtgaaatacctggcttctctgcctccacaaatctttggttttaatccaactctctctaatttcgctagcctttggagtcttccatcagacaattgaggcagtacttgcagtgccttaatctctaaacattacatatagatacaagccatatggactaaaactctccagatattttcagaaaattggacactaattttttatactttgctggctttcctgcagatggtgatggagttatgtgcagcaggttcggtcactgatgtagtgagaatgaccagtaatcagagtttaaaagaagattggattgcttatatctgccgagaaatccttcaggtgagtcttcatacagtcattctcttctgatcttttaagaacctgggagtaatatatacaatgcaccttatacctgctcacatcagatagtttaggtattccaaacataacctgtgcatcaggatatctgaaaaggccaaaaagcttttgagaaagccaatttgcagctgacgcctttaaataagctgggtaacaaactcctttgaaatcatggcctttaatacctctgtcggattaagactactgtgttcagtggatcatggaaatgaccacttggattatttattatgttgttattattttagagttctttaaacaaaaacatagcacaagcatcatagattaagatgaagatgagtcagaagaagtcagtattttatggaatggcctcaaaccaactgtagccttttggcagacaaacattttctttgattactgccccctttttaaatttctttattttccacacccagttggatgagagcaacaatcttcttgatgtaccaaattccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacattgcataccacatcatgggttagccaggtcatgggtaaattttagtggtgaatgggctagagccaaagtgttaagccaacacagattacaaatgctgtaaaatgaatttccacattcccctaaattctcagcctacaaagctgactagaaaatattttggactaaacaaatggttgggtaagaaatagagcaaaactatagctgagctgtgatattcaagatgtccagatctttactcttatggctagttggaaatacggaggctaaaaaggaaggtaaagtggcccaatgtatacaaacattacttttggtgctcttttttttcgtgggtgtcctgatttattttcctttccttatagccaaaagtcatatttctgggaacgggttgtagtgattccagcctaaagaaagaattgtgtctgaaacatcaaaattaagctgtttctcttatcaaaagtttttccaaaaatactaagaactgtaccagaaagaaagaaagaaagaaagaaagaaagaaatatatactgatgtggctttttaaaaaatatatacagggcttagctcaccttcacgcacaccgagtaattcaccgggacatcaaaggtcagaatgtgctgctgactcataatgctgaagtaaaactgggtaagtttattcttatagtattttaagtccaaaacatcttaatggagaaagctcctttaagataactatgctttctatcatgtccctgccaatatcctctacttatttgagctgggttttccctgcctgcaaaaccagtcaaaatttgaaaatttgtttgggagaggaggcggggcaaaagaaagaggatgcacatacctgcttctttgaaatcatgtagataaaacaacttttgaattataatggggatttactttttggccatcgctttaccctctattagaaatagctattatatttatttcaacaattgaattgagtatttaccatgtgcaaatttcgatgccaagggaagggatttaaaaaaataaaaaaattatttcacatgacagagtcatattttctcaagaatatcaaataacttttaaattatgtaaggatgaattgcttctttggattttttcagatatgtaaagaaatgatattgatcagaatcgatgctccaataatatgcaagtcaagttcagaattataaatcaaaagactggaagtacctagctttctatgccagaattcagagttatataatttacttgaaaataaccacacatactttctgattttcttgtccttaagctcatagggaacaatatattgtaccctttaatgtgtaaaataaatatcaatagtttttagaataataccataaaaatcatgtcagtacattgtagtggcagataatcccatggatatagaggataagtcacttgcattatttttcaacagtttgtaaacatgtgtctgaacatgaccttaagatatttcccattttcttgctaaatagatagaacaagagtagagattttgttcattcattaggaacatttttcactgaacatttgtggaagaagcatgaggtagtaattgtttattcttggaataagtgaaagtagtttcaagagagtgtattatttcttttgtgtctgtctaaaagctataaagctagaaacacaattttaaaatacataaggagaggccaggtgcagtagctcatacttataatcccatcattttaggaggtcaaggcatgaggatcacttgagaccaggagttcaagaggagtctgggcaacatagcaagaccctatctctacaaaaaaaaaatgtttaattagctgggcatggtggtgcgcacctgtggtcccagctactcgagaggctgaggcaggaggatcacttgagcctaggatgttgaggttgcagtaaactatgattgtgccactgcactctagcctgggtggcagagagataccttgtctctaaacaataaatgaataaacaatgaaaatgtaaaaaatacatgaagggcatacatacttcacatttaaatacgcaggatagatagttaatcacaaggctaaacactgtgttcgcatatagagcaacactgtcatatacttgtgtcaagttgctggtcaacgcaaacatttacagcacaaaagagaaattgtatgtaaatgaaaaaccactgaaatatctgtcacaatgtccatgcactaaagttcatgtaccttcctctggaggagagaccttctactgctggattagagtttaatcagatttactttacatgtagtccctgtacagtttgttctagatttctcagattatcattattttgaagtaacacattataaaatttaatcacacatattttgcacttaattcttttacaatttgttttaaatttttaagattatagttgtttttaagcaacatagtataagaagaaagtttcagaaagcaaacctaatgacagccaaaggaactgatagaagggaaagagatggaaaaatgattatattgcagttgcaattgctcgataatcttcatattccagcctgtaaggtcatgaaagaaaactttaaattatgccattgttgaggtttcatctcgtcttggctttcatttctctttctcttgctcttttttcttttcttctattaatcagtcttctagtcttttctcctttcattttctcctctggatatgtgccatatagcaacttatggccttcctaggtaattcttggcccctaatgccagttcacagggatagtgagaatgctgggcaattatttaacctgtttctttttaaaaatctagataaaaacatggcacaacacccaatggtgatcttcacaaatattgtggacatttttttgttgttgtcgttcttgttagatcctctaaaactgccttaaactcttaggtttttctttttcctttttcttctcttcccctaaattcctgaagcttctttttagtcagttttgttcgccatcctctggattcctggaaaccattctaaattagaaaatctacttcatttttcatccctgttttattttttctggaataaataaccccagcctacttcagccttttttctgtttctgaggataccataccaaatattttcttataatgtatcccacagatgaatagaagactgaacttttataatctaagctaagatgtagataccacagtaaatacctgcatctgattcaaaaggtctatgtaggaatttaaactaaattctagcagaaaaactcatttttatttatcagtgtgatagagccttctcatatcatgtgtgaggcttcctgatcaactgctaataagttttagatttctttgttcttgcttatagttctggtcttcctccagcttggttcccaggtccaaacactacatatgttatcatttcggaggttcagagtgtcccgacagaacattatttttaatattcatggtaaacaatcagccaaacctactgtagatttataatagcactgctgagtctcattccaaaataaatagcaggaaaagcttatttcccagtattcctggagtagacttcatggtaaagtttgctaggctggaatgaaaatctgttatccattgtggcttttgtatcagctttccaagttaaagcaataacttattaagcttttttctcctgattgattattttgacatataatgatttttggcagttgattttggagtgagtgcccaggtgagcagaactaatggaagaaggaatagtttcattgggacaccatactggatggcacctgaggtgattgactgtgatgaggacccaagacgctcctatgattacagagtgagtgtgagaattcagccagtggaaattacaatttggaaaggatttttgattaacatttatttttaatgataaaacaaaaaataaaaagcaggcagctccacattttacattaaatgctagtaggaaatacaagcctctatttcggtaagtggtttgattatattcataaaataatattttctgagaatgtggacaaagtatataccactgagagttacctgcatttgaggcagaatgtgtggtttatgttgcttgcaacctattggtaaaaatattatataatgtggatttatatgtatataaaaatttaacttccaggagcaaagggcattgtaaacttaaaaatgaataaatgtaaagccaattattaacccccacagtaacttagctccagaaaagacaaaaaataatttgattactcagggtaatggagaaaatccttggcatgtttcacttccaaaaccacagaaaatcagtgtaatagacaaattaagtaacaattcatgctatttattaaaatttccactgaaactgcaatttgaacaatatacatatatccatgtacacatttcaaaaggttgatgtggaaagaaaactctgcatttgctatagactggaaaaacctcactcactctccacataagtccaaacaattaattgtggtctccctgagtggaacctaggactcaaaacttgaagttgattaagattcatctcttttccctttccttaagtgccctttacatgatctgcaaaataattatttactgagagtctattatgttcggtgctgttaggagctacgaagactatggaagcatgttcttcaagtggctttttataaataatgctttataattgtatactttttgcagtcttccaaggactttcacctgtattcgttatttatttttagtttttagcaccatgtaactgaaagaagtcttaagcatagactatcacaactcaagctaagaaatctatcaactagggttctaaaaatccagttaacctccgaggccgcagatcacctgaggtcaggagttcgagaccaacctggccaacatggcgaaatgctgtctctactaaaaatacaaaaaattagccaggcgtggtggcaggcacctataatcctagctactcgggaggctgaggcaagagaatcgcttgaacccaggaggcagaggttgcagtgagccgagattacaccatcgcactccagcctgggcgacagagtgagactctgtctcaaggaagaaaaaaaaagagaattcagtaaacctgtttaggagtcatttagccagccgttgtatctctagccctgtgccctttccacactctgaagaaaaaaagtactaaacagttggtagtgaagagaattttctagagtctttttctagtcttagtttagtatattccaggaactgctgaagtacacacacacacacacacacacacacacacacacacacacacatatcagtcctatgtaagtgtatgctattgttatcaccattttacttagagtggaattaaggcacagggagttaaaacatttgcccaagatgatacaactggtgggtctatgtaataaaatgtctttatggcaagtttcttttggtatttcaggtaaaacgataatatcaatgcatccaagatgaactttccttgagcttaactccattccctatcaacctgttgtgtagtgaggtactggctggtcagtagctcagattatgtcttcctataatgtcactctataataaagcttcattatgggaaacccataaaagagctctggcattgacatccacacccccagctaaacattgttttgagattctaaatactaccaatttcctatttttaagtgacttttttgtcatctttgtctttgcagagtgatgtgtggtctgtgggaattactgccattgaaatggctgaaggagcccctcgtgagtaaaaaatgtttgatatttgttaaagattagggaaatgtactgtacaaatcatacaaatctctctctgtcgaagaagatgagattgccacttgtaccactcagctttcactggccacacaggtgtcatactatgtgccaaactacgaatggtggccttttcagtgattaccaaatgctttcttcagaatagctagatgtgggtatataaatcagcttgtacttttctttcttataatatcttattttacattgactgagtgttgtttccatttagtctcagtagtatttggtcctgacagtcctgagcaaccagaataaggattctggttggcgttccagtctatatttcctggtggaatatttagattccagaacatttacagtcacacagtgctactgcctcaggctgtgatagttgagaaaattctccagcatttcattgaaattgagctaatgtcaagaagtaagcctgttttttttttcctctggagtcaattcaacttacctttgtgccctctttactcctttcagctacctcagcgcccatttcatcttcttttctctacctccccatcatttaaatgacctgttagcatcctgttctctcaaggcactgctttctgataggaaagtaaaaatggaatgtaaactgggtataagtgattgataaccatctaatgtgtgactccagagcatggcatatttgctgtccttagtacctaaaatccaaaagtataaatgacaatgcatctttggtattgttggatgagaagtgtaaagtaatgccttctggggtatggggagggttgctttgctttcccctctccaaagcagatcctataggttcccatgttcttgtatgctctatctgcaaaatgtccacccatcaagttttatgagcttgaactatcttagcattttgtttcaaggccaatgagaggaatttcaagaaatagaaataatggtaacataattgttgaaaattcctggtatcccttggaatattaaagaggggctgggataaagctaggacacctgtggagatcatgttgcttcttgcctgtattataatgcccccaaatcagcaaagtacctaagttgggtgaataaaaaattaataatggaaaatgttaaacaataagaagattacatacgacacatatataaaattgaaattatactgaggggatgtggactattcctcatcatctcctgattatttctgttttggaaacatacttagattatgttaaattgagcagcagcaactaatatttcatattagtattgatgcatggatttggttaggatacatgcctgcattgagtagtatcttttttccattgtttctgaatgctcctcaccatgcctttccgggaaaccaactttctatgttttccagtttgtacttcctgggtcaccttcgtttgtttcactttttttttttattccaaaatattaagttacgggaaaaagtattgctgagcaaactcacaggagtgcagagaaggagttttgcacagattacacaaatggcaagcttcttacaaaagataagtgaaggccaggagatttggaactcacaaagggagaaaatagggctggcctgcctgggtcagtaattggagtaatacaactttggtcaagagcagccctaaatagcctccctactaaaacatttctcttttaccggtgtcctttgttgcctggaatattaattttgtatggaaataattgtcatcagtttaactgcagaaatcctccaggttatgataattattatctcataagggatggccttccaaagtgacaattatctgataatatcctctgagttccagataacaaaattctcttcctttggtcttcctttggtgagtcttttccagagaagtaaagagagagaaagaataacttctccttgataggatgccatggggcataggttcccaaaccctgggccacacagcaggaggtgagcggcgagcaagtgagcaagcattaccacctgagctctgactcctgtcagatcagcaacggcattagattcttctaggagtgggaaccctattgtgaactaagcatgcaagggatctaggtggtatatttcttatgagaatccaactcatgcctgctgttctgagatggaacagtttcatccccaaaccaaccccctacccctaggtccatggaaaaattgtcttccacgaaactagtccctggtgccaaaaagtttggggaccactgttgtagtggctctagaaagagagaactggacacttgtaaaccaggaaccccttcagtccctagtttctgggtaggaattcaaacaatacggggacctttataccaaggccagaacatttataataatcatccaaacatcagagtatcataggttaattttgaatagatgtggtttttagtctctatcttttatagaaaagataatctgtgcctggaggagaagcgggataggatcaatagttaagcctgacacccctttcttggcaaagctgtacactagtcaacttgccttaacctggaccatattttcccctatttttgcattctccttgatattgtagatcattttaaatattctcaatgatgcttctttatagtcctacttctatcccttgtagtgtcactctctcataccccatgtctgtctttacctgagtgcattgtggctcaaatctaccccatcccatcaagaggcttattccttcaatattcagaagattccctcagatctcaacatgtgttaagaataaatcacattatttaacctaattcagactaagcccaatttaatatgtgtccaacccttcaagagataatgtgatttttaagggaggcttgctgtttcaaaggaatgagcctctaatgatgaacatttaggtagtgttatgagatataggttggagggggcagttactgacattcctgaaattagactatataggaaaccataaacagctactgttgacatagctcttgtacccaccctatgctccattcctttgtgaacttttcctttccgttaaagaaaacttacctagtctgtgtcctagctcttgacccctgaagatgttgtcagtggactaactgttgcccagatgttaataaatgacaactgcttaatattgtaccaactcccttacaataagtttaaaggacagaaactggagactgattggacatagtaaaagaataaaaagggttaaatatgatcctgatactttgtacttggagctaattctgccttcagttataaaaatgcatcttctattaatttatacccatgtaattgaaaacaaagcttggcctttaaacaattgcctttgtatagccctaataaaatcactctgtggagtttttgtctactactatgaaaggccagtttgtcactttaggtatttctgaggatgcattttgggagagaaaggatggctctatcaagagtcattaatatcaaattatccttacaagaatgacacacttgtaatgttagatgaaattgacactgtggttctccattggggattttttgcactgccaactttctttaatcaaaacacaagaggaaataagtgagacatatttaaacacttatagaaaaaaccaaatttcccaaaccaatgaggtaattaatttatatagcacatattggaataggtttttatttttatgcctgtgtgtatgaaagagagaatgaatgtccagtaatttggcacagtctcaaagtgccatagagttaacatctttgttataatatcaatagctgatatttatttagcatctactacatgtcagatacttttgaggggattttaaaaattatttaaaaaatttttgtgcatacataatagatgtatatatttatgaggtaaatacacttttacttgtaagtttctaattaatcctcacaacaattctttgaagggattcctcctgctacatttcctgtttttcaggtgaagaaaccaagatacagataggctaggtaatttgcccagtcacaaaggtagagctaggtttgaacgcagatgatcttactctagggggtgtattcttaacagttgcactatacctattttttttttctagaactctcagcttccaaaacagatgcttctaagctttctagactactaaatcattgttctttaaatattattgtactaagctagtagtctggttgaatttttcagtctgtaattacatattccaattttataactaaatacctgcaatacaaaaacatagaagtgtgcttgtttcactttcagttaacttttctagatataaattatcaactatacatttcaaatattttgtctagtttattattaatttatcctacttggtgatagtgaaacttgagaatcttatatattgcaacattgcattaaaacgagcttttctttttcttttgaaatacattcttttgtatctatttgtcccttagtgtctactcaacataatatgtgaaagatcactgagaatcccctctggaataaggagtgtgttctttagttacccttctcattctttctaaatttatctatttccctttgcagctctgtgtaaccttcaacccttggaagctctcttcgttattttgcgggaatctgctcccacagtcaaatccagcggatggtaaagatgaatgtcttaatctcctaattacattgacttgacatttttatgttagcaaagaagttttaattcatttggtcagtcctgctgcaccatcctggttggacaatatttcctaaagtctaatatcttaactgggaggtctaaatgaccagttttcattaagaggtagctagccaactataaataagtaatatcctctatagtattttctgatgatattactgtactgccattaatgggcatgttcagttgtttccccagtaatgggatgaactgatggcaactatttgtgaagtttcttgtgttgcttatataggcagtcagttatatgcagccctgttgattagtacattaaaccaaacacacacagacctagagcagaagacttgttttcccagggcacttacatgccagctaaacttgggaatccttctctctgaagcttgttgatcttgtacctgaaactcttgcttattattagtttttattgctttccctggtagaagtggtgactgtgatttgattgttaacattctgcattggaattcaatttaaccctttccatggattcagtttttatggccacatctgttttcatgggtcattttacaagattagttagtcctggtgcttttaacatcctatttttggatcattatattcattcctctgtagttaaaactgcatatagtcaaatgaaaaatacagagtatgactgctgtgggccgatcaatctagtcttgcagactacatatatcacattaaccatttaatcatcatatctgcacttgagtttttaccaggtacatacagttaactcattgaaacttctactgtaatttagatggaatatgctattgactcttgcttctttttctgaggtctaaatggcctcactttataacgtatgttgccaaactgcaggatatttggcaattgagaagacaataatacctaaaggcaactctctccaaatatgattttcagagaggcatgtgggtggtggtgggaagaggtctgacaggactgagaacacttttttttcctctctttgactcattttttaggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggtagaatctgttaagttttattttactgaaatgaatattcagagtttattcatgtattgtttccaggaaaaagtaatatttgtttaagacttagattgaaaataaaacttctgaggcctttgatatttagttttgccaataatatgccatgtgctcttatttaattttctcttgcgtgtgtgtgtgtgtgtgtgtgtgtgtgtgtgtgtgtgtgtgtgtatagttactaattcttgcagttacacctggcaaatgttcatatttatgaagaccttgaaagcatccaataaagttttgtgatatgccaattttaagtaactaactaaataaaataaataaaagataaaaggtaacaaaatgtatatcttgcttttttttcagctggtattttgactctacaagagataaatggatttgtaattaaccatttattcactgctaattttgaagtagtatttgtgcaccatacaaagcttgttttatgtactaaactccaaatataaaatataattaaaggaactgatttatacaaataaacataaacttctgtctattaataaaagtgaacttctattaaaaatggcaggatttgcagtgagccaagatcatgccactgcactccagcccgggtgacagaacaagacgctgcctcaaaaaaataaaaataaaagtaccaggatggattttcaccaagtccagaagaagcccctgggaagtcctaactttatatattatattacatattccacatttgattttgcggaccataggcagagttgagagtaacaatggaatgtaaaagggaaaacttgaaaaagcaggcatcctcagatcagctgtgggattgattgtagtggggcttgttgtatctatacatgtatcatgttttgaggcaaggagcagcaagaattaatttatttacctatggtaatgaagttattcagccaactttacagaggccagccagtttcaaatgggttcaggaaaaccacacatctatatggtaatttgctaatttccagaattgcaaaatttccaaaatgttacctgtaggaaaagttccatttatatggaagttacactaaagatataaatatagttgccctgaacattttaatataggaaattcaaaataaaactcttgtttgtaatcttctatatttcagtagtcacagtacagctgatgataggaaagaagctgaatgttttcaatgtgtttagtgtaaaacacagaattaagaatttgccttctcattgaaaagaccaaatatcaacctcaagccataaagtccttacatctagagcccacagctgtaagccatgctcaccactatttagagtttctcttgtctcattctccctttgtcccattctctcttcttcctctttagaattgcagaaatcaagttgctaaattttctctgttcagagaaattaatctgcatgcaatagctatattgtgctgcaaaagtgggcctagaaactagaatatggtctacatcacaaaccaagtacttttgaagggctaccttcttgcccttgtaattcactccacatcctaagaagcagagggaacaaggtgattaagtggataacatgcttatctgctgactgtttatgcattatgtttttctcttttgtaaaaaaaggaatacctttgatctttgaaagagaagaagctattaaggaacagtacaccgtgagaagattcaggtgcgttccacaaattgcatatataatttgatgatagcaattcacataaggccgttgattccatactgttgcctttggttcagaaagacttaattctttctgatacaacaaataacaaatctctgtttttaagagatattgagtgaaaatgtgagaattctttattactacccaaagactccttaatatctggcaagtgaagatcaagtagatatcatatttcattaataattgaatacattagtaatacaaatgttacctgcagaatatttcagacatcaagggaatgatttcagaaaggtttactgaaggtatcttcattgcagaaaatgtccatcttttaaagtaaaaacaatgcccctgaatggctccattccactaaaaattctaattgtatgccaatcatttgtgtgtttattttagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagtaagaatttttgatatttttactctgagtcaaaaatgaagagaaaatgtgatagctcatgcggatgttttttctcagtaaaaccaaatgaaataaatattccttgtgttctacagaagatatactaaataatttgtacttcaaataaattttcatgaaatttctagataattgtaactaaatatgataaaaatatttttcagtatctctactgaaatatagctttaattattagttttctgtctattattctttaaccaataaagtgtcaacgaatgcacattaaaaattactattttggatctttaaaaattactttcatagcttaaaatttcaaagataactcatcaaaaataagcacaaaacaaaatttgcttttgttactctaacctttaagttagtttattctttcttccaatagaatgccaaactatactatttgagtgaattacactcatttttgtactacaggatgtttaaatcaaggttaaaatgagaaggcaaagcagtttccaaaatatttggtatatggttaccatatttatgacttgtttcactaatttgctgcccgttttacataattaatcaattatgtggcctcacagaacgtgaaacaatttacaaattattctccgtgttagaagaccaacaggttcgtatgcccactgcatagtaacagaccaattacacatgcatcaagaatgcagcagaagagtttaatgatcagcagggcatggagtgaggaggtggggaggagaccctcaaatccatctcctggaggagttctgggatggggtttttaaggggattgtagagggtgaggtgctggataattggagttgttgattggtcagggtaaggttgatggtccttgaaatcatcaggatgtggaaactgcattttttgatgagtcagcctcttgtggggtccttcagaccagttggcgtcagtggggtccttcagaccagttgattgacaatagtttcactggtatgcaagacctgaagaaatatctcaaaggaaaaacaacatttcataatgttcaagttgttatctacagagcagttaaggggaatgatgatgttgcaacaaggtctacgtgagtctaggaaaataggcaacaaacatctattgaggaaggaggtcagagagcaagctgacctaaagattaatgctaaacgtgctgcaagcttggtatatttttgtttcttcccctctcttcttctgtgattaattttataagttaataagggtggtttcatctgtacccttttgaaatgtggaatacagtgtgttaaactccattttatctaagaacagtcactaaaacgtaattgtttcaaaaatcctttaataaaaagtgaatataattttactggagttattgaatttaatctggtggattctaaactgataatgaagaattatgggcttgataacaaattaatgaggttagataaggttaggggagcagttgttttctaatactccccacatccatttgtgtaaaaggaatcattgtgatgatcctaacttatacccttttatccacatctatttacccaataataatcattgtaataattacaaatgaattttatctgagtatctagataaggaattctttgagtttgtgcacattgagccaattaaacaaatgctaatttgttgacatgtttaacatgagaaaaggtaggagcagcaagagaagcaaggcccaaaagggaaaatggatgtctagttctcagagaaaaagggaactataaggagcaagaaactagatggagaaaagggaggtttaagtctagaatggtgacatttggcaaaaactagctcatctaaaatgctaatgattattctcgatgaaccctagtaatcaattagatctaatgggttttgcatttatgaataagacttttattgatctctgaaagattcagtgataccagcatggcacacacttattgtcatttattgttttaaacatatatgtggaaagccattctaaaatttttaaaagtcaataaataatagttaccaatctcatgactctaggatattgtacaagcatttatatctttatatgtggtcgttgaagaaaatataaaggaaaagaaaattattgataatatagtcaaagtcacagatcttcatgatacctgaaattttattagagttgagagacataggtgggtgctttaagtcaccagcaggaaacaaaaaatgcatttttattaatctttcagttgaagagataatattgattggattaaaggggaaaacagtttcctaaagtcctagatctcaattagggagaaatatttgcaccactgtattacagatcttccattgctcaggaagaccaaactttggttataatagcttgctaaatgtgacagttagtttggtgttatgagtcaatcaagttttaggccagagattcttaacctggaccctgtagatgaacttcaggaggtcagcaatccaccagaaaatatatgtaataggtatgtctatatgcaattttctgtggacagtctatagcatttctcagattctgaaagggatccagaaccaaacactattagaaactactggtttaaatcatttttaatatttggatattattcttttaaattgtgtattattttaaattatatattatataatacatataaacaattcagcattaagatgatgaagttgttcctatcacttgcattttaacaacaattaaaacaattactttcctttttgtttcaaaggacaaagaagatgaatcatcagacaatgatgaagtatttcattcgattcaggctgaagtccagatagagccattgaagccatacatttcaaatcctaaaaaaattgaggtaaatttttcaatatgagttgttgtgacattagtaagaacccagaacagtggttcttaaactttttggtctcagtgtccctttatactcttaaacattgaggacctcaaaaagctttcattttttacatgggttgtatcatttgatatttaatttattaaaagttaaaactgaaaaacatttaaaatattagttcatttaaaaggaatgaaactattacatgttaacataagaaacacatttttaatgaaaaaactgtattttcccaaaacaaaattttagagagattgacattgttttacttttttgtaagtctcttaaatctatcttgcttaatgaaaaacagctggattctcacatctgcttctgcattcaatctgttgccatgtgttgttttggttgaagtatacgaataaaagctggcttctcacatataggtagtgggaaagagtcaattttcatagattgcttagataattgagtaaattattgaataatgtaccaaaactagagaagtggaatctaaaaccatatcaatgaaatgttgtatattcagttaataataaaactcattgatctatcttatgctatgaatagatgttttgcttatgcatgatttttaacttcatgcattgatcagttggaaaatactggttcactttgtatatagatcttcccagacatttacatgtttcattatacaatatcaaaaaacagcatttgttaatgttaccatcaagttcatcataaaagttactgagtgttgttaaattgtcaagtgcttggtgggagatatgtttgaaaattctaattttcctttgcaagctcaaattttatcattgctaaattgtggcatcattttttccccttaaattgacaggtttactttattcattaaaaataaaatgtctaccaaatacccagagtttaaataatcatagtttgtcagtctttctttaagcaaaaatattgtacattaaaaattctggcagtttcgttttgtaacacaaacacaaatatttttccttgattagctctggtctggaatgcagtttgtgacagggtctgggacatttaatctatgttttgttttgttttgttttacaattataagaataattaagttagtcctagtgtccattttgacttctgttttcatgagtatattaatagtatcctatttagaacatatattggtgaggccggagttgtaggttttcttgtctagaaaaggtagcatcatcatcatagccagtattcctaatagccagccatctaaaacaatctttttgtagattgttttgaacaatcaagtagattaggtgagtgtgtgaagaactcaaactcttgccttattgatggtgggtcaggagcctcattgttgctcctaatcagcacaagatgttacacaggagtctactatgaagtcttttatggacaactctcatttttaagtacaattcccctaatactaacagtcctctgaagttaataacaaagagtattgttttataagtactaaccactggcagaaggtacataagccagactgtattatataattagaagaggcaatatgtctttttctttgccttattaaatgactttactcaaactcacaggtaataattattaccttaaacctgacactttaagcaggaaatgtaatgagctgtgtctgatttgaaatacatcattatcttagtatatgctattcttactaatcattttcttctccccagttttgaaattaaatacagccaatttatattaggaattatattttttatttttggccgttacctattttgagtaatttttgcctccagtagtgacaataaacttcctaagatcagcttcataagccaaaagtccccgactgggtcatatgataccaattatatgaaatgaaagtggaaaaaaataggcagatacttaccctcacctacttgtctctcggagtgtagagagagccttgataagccacttcataaagaaaaaatagtttactaaggctactctagtttctagaaagtatagaatgagtttatcagcatgcatatgctagattaaaaaagtaacactcttaaatttcctttttaaagaatctagtatgactgccttattgcatgtcagaatgacctatgttttgggcagctaaaacttctttgagtagaaacctggtgatacaagtcttagtgaggcaaggcaacattccctggccctgtctaccaatgttggcagaaagtaaaattcccccattggtggaagctggcttattatatgcaccctttcttgagtatttggctatattcaatgattgtatgattagtaaaatgcaaattaatctatttagagttgaaacagtacttggaacactaattatgatagtacagtcaaattgtaaagcagaaaaacatactttcttactttcttaaagatgggacacttttgactagagagattttaatgaaatgtatgtatgtgtgtgtgacaacttttgaaaatctagggttagcttaaaaggatgagtgtataagaattagaacttaaattctgagtaagaagtttaaacttgatataaaaagcaatgtgataacatggaaagaacattaaattagaagttgggagacctgcattctgattttagacgttcctttcacttgacataaaattcttagaaaagtcattttccctctttaggctacagattcctcaacaataaattaagattttgattatatgagctccagaatctgttcctatactaaagatcaaatataccatcagaaattatggttaagcaagtctaatgttgtaagtcattatgaaatagaatctgtttattaaaatcatattttataagttagattttaggaaaatatatatgaagacaggcattttcccacaaattaagagctcagtacaatttatgatcaagaattctactgaagtattgcattgtgtctttaaggttcaagagagatctccttctgtgcctaacaaccaggatcatgcacatcatgtcaagttctcttcaaggtatgtgtctttgatttctatattaaaattattcataattatcaaatggaaaattaaaaattatttcattgataatacactttgtgaagtcaactaaaatatccgtgacaacatcatcaccattgactttattggcccacattgaaaaccttaactgcaatgatccattacctatatctttcatatttggtcatactgcagtctctgtgatatttagtttgctaaatagatggcaaggttcacaattttaaaaagaaacaataataacaaatactttgacagtattcaattagtagtcgatgataaaaagacatgaaatttcaagtgaattttcacacatgtgctgcatgataaaacacacacaccaattgtctttaacttcagaagctaatgccacagaatgggtaagcctaaaaatgtcctatagtcaaaatcaaatctaaaactcaatattatataaataaaatatcatatataatattgataccagtcactgtattttttaatctttgtaatattggtgatcttcaataattttcaaagatcacgttccatatgtcagatattgtgtgcattctgttatatttgaaaactaaattttaaggtagatttttttaagaaaatctcaccccctccagccccaactcacaatagagagaacttagcctatattgattcatttagtcagtaaatatttattgaacactcactatattcaagatattggacagtatggccagatggcgtacagttaatgttatgtagtatatattttcttgcttcattactttaaaaaacccatacaattatgtcttcagatttaactggagtgcagaaatcttgaaaaattgtaaagcaagactgcgaactttctttttctctgcactcaatgaatggattgtcatggtcgaactgacctcaaaggaaagaaaccagtttagttttgagtagttggttttggtatcatggaacatgactttaataaaatccaatatataaaatccatacttggtgttaaactcagagtaattgttcactttacaaaaggattttgaatttatgaataacaaatacgttgcctttaaatatagttaaatttaaaaagttaacttaaatgaaactcaaatctttccggaaatttggggccatggaaaaaagtttgtctattccagacctaaatcaataaccaaagtccttcccatatagaaataccaaaataactgtaaaatttagcagcattagtccaaagaaactctctaaatattctttaaatttgaatagtaagaacgaaagtgctctatttttctgtcagtgtagctatctaaatccggaatgggacgttaaaaacattaatttcaagcatttaaaatctggataataacaatagaatatatgacataacagtaacttgtttattatgttaaaatactcacatacactataaggttatgtttattgctgtgttactcaggtaaaatattgtctgaatgttagctttaaaagcttatagaaatttttagaaattaatatatatataaaggaaacatatactctatgaaaacatatttttcttattttggaaatcgttactctattctagacaaaatagcaagtttgggggagaatggaaactggaaattattactcaagttatacttctttttcagtttgatatgtacccatatatttaaacaaaactttgtgttggactttatgttgagttgtacattccctttatgaatgttaggacatggcacatgcttttctgtcttttcattagcgttcctcagcggtctcttttggaacaagctcagaagcccattgacatcagacaaaggagttcgcaaaatcgtcaaaattggctggcagcatcaggtgattcaaagcacaaaattttagcaggcaaaacacagagctactgtttaacaatttatatttcagaagtcaagaaagaagaatttcaagaaggaatgaatcaaaagtgtcagggagcccaagtaggattaggacctgaaggccattgtatttggcaattgggtggtcagtggtggcctttgagaaatggaaaataatttttctgaattttcttctttttgttgggtagtagttaggaatgtgtctaagaaggcggggggagtcagctttattaggtttctataccacgtaagaaaagtatggtaaagaaacttgagagagacctctccagcaggctaaaatttataggtagcaattagaatattgtatggaggagttgtgagtgtgtgtttcatttatcagttggttacttcacctctccaaaataggacaatatctgataaatatccctaaatgttacagagtgatggttttactcaaaatacatgaacaattaatctatcaaatcatagaaaataacttcaaaagttgtgatgtgaatttcaaaaaagtattttaagatgtgcttttgagagagtttaaatgaattatagatttatgaaatattaggataaacaaagccaaaagttgtgccatggatcatgcaatctggcattatccagttttaagcaatccaggtaagttaagcaagggaaaaatggctgattgagttgctgatatgtaaaaatatagtatactgattttattaaaatgttaataataaaaatgatacagatgtacttcactttttgaaaagtgaatatttgaagatcaaaacttaaaacacattattcttcttaagtgactcagattatggcagagttcttttaaatagcactgtctcctcatacacaaatactatgttgtgaaaattagataagcctgagtgaaaagcaaatttttaaaaattttttcccagagtcttttctttctggcttgactatggctaattttgctaatacagggcaaacaactaaaaatttaaggtttattcatgtggcatctttgaaataaggaaattctggattagatcccaaagcagtcatagcattgatagaagggagaaggcatctgtgcagataatagctaaatgtcttttcagctccaaatttcttttattttattgtttatgctacatagaccatttgatattctcatgaaattatatgcttcattatggaggaaatctcagagcaccttactataaatttgtctcagaatcttagtgcactcacttgaacttatttggtctactaacataccaaaagacttaaaagaaaatggtttcctgaaaaaaaaaaaaaaaaaaaaaagcacaagtacaacagtgtcagaagatggggacacaaattttagcatgtgttcagtgtaatgttctcaaaggacagcagtatttgcaaatatatgtcttttggagttggagtatctatactttggctatgtataccaagactgaaaataagagggacaatagtatttatcttgaaaatctaagcacacaaaaacattaaacagggacctgagttttctcttagtgaagctttttctaagtacactcacccagacctgaattttgagcctgttaaatattctcaccagattttaatcacaggggttatttaccataccacaactcaatattaaaacctaatctccaaaccagatacatttgtattttaaatggaaatatttacactatagaattgagctgttcaatgtggtagcaactagcctcatgtagctattaaaataaaaagtaaaatgaaaattaaataaaatttaaaagtcactttctcaggcacactggccacatttcaaatgctcagtagtcatgggtgactaatgaccactgttaatggacagttcagatacagaagatttctatcactgcagaaagttttgttgtacattgctgctataaaaaggttcccagctttatagaaacgggtgttatctcttttcagtagttcactcctcaactgtattgaactacatctggatatatcattgggtggaaatatgtgggggttaagattgaagaatgtaaatttgtttgagttcattgtagattctggatattagccctttgtcagatgagtaggttgcgaaaattttctcccattttgtaggttgcctattcgctctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgaaaggaagggatccagtttcagctttctacatatggctagccagttttcccagcaccatttattaaatagggaatcctttccccattgcttgtttttctcaggtttgtcaaagatcagatagttgtagacatgcggcgttatttctgagggctctgttctgttccattgatctatatctctgttttggtaccagtaccatgctgttttggttactgtagccttgtaatatagtttgaagtgaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctagccatgagcatggaatgttcttccatttgtttgtatcctcttttatttccttgagcagtggtttgtagttctccttgaagaggtccttcacatcccttgtaagttggatttacaagataaaaacaaacaaccccatcaaaaagtgggcgaaggacatgaacagacacttctcaaaagaagacatttatgcagccaaaaaacacatgaaaaaatgctcatcgtcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttttagggacgtggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggagtggggaggggtagcattgggagatatacctaatactagatgacgagttagtgggtgcagtgcaccagcatggcacatgtatacatatgtaactaacctgcacaatgtgcacatgtaccctaaaacttaaagtataattaaaaaaaaaaaagattgaagaatgaactctcctcttgagggttttggctagtctatcatcttctaataaatacactgtcgggcttttttttctactggtcagtatgtgaggccagtggtactcccagtccttcctactcttgatacatttttttaaatgtatctacctggctatcagttggactatgtatcttcttacatagatagagatatttggtaagtgtacacttaatattgaaaacagagcagccatgtaagtctacagatggaagaaaacttgaacccctgctaatacccctgaaaagagaatttaagatcctggccccatgagaattttcaggtgatacttcctgaatggaatcataaaaatgaccaagaaaaaaaaaaagaaaaaaaaccaagggatttaactgatacactatacatatgaaggcaatggctgtaatcaccattgttactaatgtgtttttggcattccatagaatcttcttctgaggaagaaagtcctgtgactggaaggaggtctcagtcatcaccaccttattctactattgatcagaagttgctggttgacatccatgtaagtttccatcttaacacattaatgtctattattttttattttccatttattttgacttacacattctcatattcacttgagggaaaggttaaagagtttagttttttaattaacattttaaggatagattctcattgctttgtgaatacatagaacacaaaatctagaaattaaaattgaaatgggaaaacatttaatcaatcagagaatattttattttcacattcttgtgtcagttagaacatgtctgggagagtagtgataacaagctgtttgtaaaacctaatctcagattgaggggtacaggttagatgtccaacttttaatagcattccttgagtgatgaggcaatgcataaatataaaacatttagtaaaaaacagagtgtcctctgactgcataaataaaaagtcttccagctctttgtgaacatgtttaaattgttctaatgcagattttaaattgtcctaatgcaatgtgctttcagattattctatttcaattttgaattacctctatgctaccgtacacacatcccttccagattgcccaaaagttgttaaatgatacataccatacttaaaagatggatttagattaatttgcactttggaagtgtttgagatactttaagacaacccatggcacgtaaaacctgagctggtaaattaacatatcaatttcaagagctgtgtgttaatcccaatgtcaggggataaaacaaaagggaaaagttaccatttttaaggagcatcaaatctcctgttctctccagcatcaaaagcaagtgtccattcctgagctgacaagtatgggtattttttttaagtgagtaaattttgccctatgtgatccagaaaggccactaataatcacagtctgatgtttgggttttgacatctcatcctcactaaaattttggctccatctaatgagtgaacatccttgtttcagtttaaaatatatttcaaaatgttgtcagcttggaaactttccaatctagaagaaaatgaaagctactagaggctacattaacctttcttgtgcacacaggttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaaggttggtttttttgaattacttatactctccatgttttatgactgcagagctatttgcatttttggtttattttcaaaatttattaccaagagagtgacctaatttcacttgcattttagtaaatagtttgattgtcaataatgtattttaaattgttctaatgcagaacatctaattttgtgtcatttgtgtattttaaaataagcattcaagtatttattagtttctttataactggaattgtctagatgcttatgttaaaattactgccactgaatcatcctactctataaaactatactgagtatgagaaaggacaacaaagaaagtgtgtaacttaacaagcataagatgaagtcttggtatttgcaaacatagctattcatttctcaaacttttgtgatatcactatatatatatatatatatatatatatatatatatgtgaaatttaagatgatctttatctgtttaattggtggagaaattaccaagagctcttttaattttttccaaccaaaaaagtctatcaagaattccattatgaaataaatttacttttagaattaccacaggcacgtatgtttaattttgtttcctatgcaaaaagagagcattggcacattttgttaagcttagtatttttagcaattaattaaataacttagttccacaagacatgaggtatgtattgctgaacttccttggtgggagtagtagaccaatggagttctatagcaaagcagtcagtacacatgttagaaaatcaaggcacatgttgaaatgaacacaaactagatatactgcaagaagaattaatcatgttgtggttgagctaaaacataggcttaatcattcatgtgtctgtgaagttgctaatgcatgaaatagtatatatttaagaaaaaaactacatattcttgctgttaacctaatacacgcacctaacaaagaatacaagttctcttccctctgccatccaaatgcatctgagaaattggtggtggctatggctttaatcattacataagactgagaagacataggggcatttttatgttctttatcataccagtagtgttcacatagaacaaagacaagcctgggcatggtagatatgtataagacacatcctaattctgttgtacttgctaactttcaaatgtgtttttattgcgtgactttctttcattaattggagcttgttgtcagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggtaatgcaccatttgaaaagcagattgaactcctctcattgcgaatgtgtttcttcatgggacatgtagcatttctagccattccaaatagattttcatcatataccccaaggccttaaacatttttaattataggtttgtaggtggatccttattacctctaatttgggtggttcctatttacttccaaagacaaaaatctcttatttgtttgcctttattactcagatcacatatttgaggtagtgtctcttgacacacactttttaaaaatattttaaaaaattaattgacacctaataattgtatatatttatggggtacagagtgatattttaatatatacaatttgtaatgatgacatcagggtatttagcatgtctatcacctcaaacattcatcattttttttgtgtgttgggaacaatcaatatcctctctcctagctatttgaaaatatgtaatgaattattgttaattatagttaccctatagtgctatagaatattagaacttatatctcctatctagtcatgcatttggatcctttaaccagcctttctctatcactctcccgtactcctcttcccagcctctagaaacgactatttactctctagttacttgagaccaattttttagcatttgcatatgagtaagaacatgtggtttttatctttctgttcctggtttatttcacttaacattgagtccaggttcatccatgttgctgcaaatcacaagatttcattcttttttatggctaaatagcatttatttctgtatatatgtcatgttttctttatcaattcatctcttgatggatgcttaggctgatgccttattttggctattgtgattagtactgcagtaaatatggaggtgctgatagctctttgatacactgatttcctctttttttgagatatgtacctagtagtggaattattggatcatatggtagttctatttgtagttttataaggaaccacaataccattctccattgtgggtgtagtagtttacattcccaccaacggtatataaaagttcccttttctccacatcttcaccaacattaattttttatgttttgataataaccattctaactaggatgagataatatctcattgtggttctgatttgcattttcccgatgattaattatgttgaaattttttttcatctatctgttggttatttctaagtcttttgagaaatgtctattcaaatcatttgtccattttgtttattatactttaagttctagggtacatgtgcacaacgtgcaggtttgttacatatgtatacatgttggattatttgcttttttctgttgagttgtttgagtttcttacattcaggattttaatcccttgttggacgaagagtttgcagatattttctctcattcttcaggttgtttcttcactttgttgatcatttccttttctgtgcagaagatttttagtgtgatataattctatttgtctatttttgcttttgttgcctgtgctttggtcctattcttttttcccaaaccaatgtccacaagcattttcttatattttctagtagttttatggtttcagatcttacatttaagtctctaatctattttgagttgatttttttataaggtgagaaataggggtctaatttcagtcttttgcatatggatatttagttctcccagcaccatttattgaagacattgttctttccccagtgaatattcttgatgcctttatcaaaaatcaaccacaatgagataaatgaatatgtggatctatttatgggtcctttataccgttccattggtatgtgtgtctgttttttggttgctgtagttttgtagtatattttgaaatctgatattgtgatgcctctagtattattctttttcctcaggattgctttggctattctaggtcttttttggttccatgcaaattttaggatttttttcctatttctgtgaagaatgtcattggtattttcataaggattgcatagaatctggatattgcttgggatagtagggtcattttagcaatattaattcttctagtccatgagcatatgttgcctctccttttgtgtgtgtgtccttttcagtttccttcatcaatgttttatagtttttcttgtagagatctttcacctcattggttaaatttatttccaagtattttattttgtagctactgtatatgggattgtttttgtgatttctttctcagctaggttattgttggtatgtacaaatgttacagatttttctatgctgattttgtatcttgcaactttactgaatttgttcatcaattctaagaattttttggtagtgtcaaaggatattctatttataagatcatgtcatctgcaaacagacactctttgacttcctcttttccaatttggatgtcttctattgccttctcttgccaaattgctctgattaggacttccagaactaagttgaataagagtggtgaaagtggatatttttgtcttattccagttcttagaggaaagaatttcagcttctctcattcagtgtgatgttagctgtgggtttttcatatatggtttttattgttttgaggtatgttacttccatacccaaactgtggagagtttttatcacgagggaatgtagaattttatcaaatgctttttttggtatcttttcacatgatcatataatttttgtctttgattccattgatgtgatgtatcatgtttattgatttgcatatgttgaatctcccatgtatccctgggataaatcacactcaatcatggtgtataatatttttgatatggtattggattcagtttgctagtattttgttgattatttttgcatctatcttcatcagagatcttggcttgtagtttttgtttgtttgtttgttgtaactgttgtgtccttatctggttttgagatcagagtcatactgacctcacagaatgagtttggaagaattcccttcccttcaacttttttggaatagtttgagaatcgacattagttcctctttaaatctttggtagaatgcagcactgatgccatagggtactggacttttctttgttgggagactttttattgctgattcaatcgcattattcattattggtttgtttaggctttctatttcttcttggtacaatcttgctaggttgtatgtgtccaggaatttctccatttcctctagattttctaatatgttgctgtgtagtttttcataatagtctcttatgattctttgtatttctgtggtatcagttgtgatgtctgcttttttgtttctgattttatttgggtcttttatactttcttgttagttaatctagctaacggtttgtccattttgtttatcttttcaaaaagccaaatgttcatgttgtatttcttctgtattgtttttgagtctcaatttcatttacttttgctctgatttttattatctctttatttctattaatttggggtttggtttgttcttgcttttctagttcattgaggtgcatcattagattgttattcaaaatctttctacttttttaatgtagtcatttattgctataaacttgtctcttactactgcttttgctgtctcctataagttttggtgtgctgtgtttctatattcatttgcttcaaataatttcttaatttccttcttatttattggctaattgatgttcaggagcatatatttttaatttccatatattgttacagttttgaatgtttctctggttattgatttctagtttattctattttggtcataaaggatactcaataataatgttgatttagaaaaatgttttgagacttgttttgtgtcccaacatatggtcagtcttagagaatgtttcatgtgctgatgaaaataatgcatattctgcagctgttgggtgaaatgttctataaatgtctgttaggttcatttggtctatgctgcagtttaaatccaatgtttctttgttgattttctgtgtagatgatctgtccaatgcagagagtgaggtgttgaaattctcaactattattatattgtagtttatctctccctttagatgcaataatatttgctttttatatctgggtactctagtgtttggtccataagtatttataattattatatcctcttgctgaactgatcctattatcataatataatgtccgtgtttttctcttttttacattctttgacttttaacacctgttttatctgatataagtgtagctattcacgcttgcttttgatttctgtttacatggaatatctttttccatttcttcattttcaatcagtgtgtgtcattacaggtaaggtgaatttcttataggcaacatataattgggtatttttatttttttatttttattttttttactttttaactgttctactagtctatatgtttaattacagaattttgtctgtttactgtcaagtttattattgatatgtgaacacttactcctgtcatttcgttaattgtttctggttttgtgtatccttttttttctattctcttattgttaatctatgttgttaggtaatcttttgtagtaataaggtttgattcctttctatttcacctttctatacctgctttacaagttttataatttcatgttttcatgatagttgttattgtgtttttcctttcagatgtaggactcccttaagcatttcttgtaagacctctctagtggtgatgaattcctctgctttttgcttatctggaagaggctttatttctccatttctgaaggattgctttcctggtgatactattttgggctatcaggttttttccagcactttgaatatatcatcctattctctcctggcttgtaaggtttctgttcagaaatctgctgttagtccaatgaggatttccttatatgtgataagactctccttttgctgtttttagtattctctctttgtcactgacttctgacagtttcactgtgattttctttgggaggacctttttgagttgaatatatttgataacctttgagcttcctgaaactagatgttcatatctctctcccaagacttgggaatttttcagcttttattttattaaataagttttctacatcttttcatccttctggaacccccataattcaaaaatacatcctcttaatgttgtcccataagttctataggctctctttattctttttttttctcttttttcttttctgcctgaatcattttaaaagacatgtcttcaagttcagaaattctttattctgcttggtctagtcagctattgaagctctgtattgtattttttaatattattcattgaattctttatcttcaatatttctgtttggttcttttttaatgatacctattcctttgttgaatttctcattcagatcatgattttttaaaatttcattgatttgtctatctgtattctcttgtatcttgctgaatctccttaagatcattattattaattccttttctggcacttcactttttcttttctgttgggtctgctactggaaaattattatgttcctttgaaggtatcatgtttccttatttgttaatgtttcttgtgtccttgtgttgatatctgtccatctgatggagcaattgcttcttataatgttatggagtggctttcataaggaaagacttagtccatagatgggtcctggggtgttggttgggttgggtgcattgactttggttctgggtggatgcagcagtgtggtctctatgctgtaatatacattagcaacgtttgctagtacctcactggcccaggctgcaaaagtttgtggcagaggtggcacacctttgccaggggtgggcttgccaggctgtttctcagtccagaggcaaaagtgcacatgcggtgggttgggtggctcaggaatttgccctccagtgttgagctatcagactacttctctgggcaagagtgtggtcacacagggtgggaaagctagcttggggtctggcttactgggatcagtgctgctgagctgtttctctggccagggttgcaagtgcacagcagttaagccagcctagagttggcttcgccaatgtgcagtactggagttatggctgacctttcctgggcccaagatctgagcagtcagggtcacagcatttcagccatcagttggggcttggtgaaatgacagtggagctgcaagactggagaggcacagtgtttactggcccccagaacatagtgtatttcagcagtgcctctagattcaagatggcaccaggctgcagcagcttaggtcatgggttggtgggaaatgcacaacttttgctccttatctggagcaatgcagacacatgaatttcaggcaccttcccaaactgaactcagggcttgtgaggactatgagattctcctgtagtaagtactacagttgtctgtggtggcaattggggctgatgagagtcttctgcttaccttttcccaataaggagaatttattccgggctctgagctgatcatggtaggggagatggggcagcagaagcagagtacctcacttccctctctttgctgccattttgagattccatgctacacagtgacctcaccaccccatcactgcactccaacactctccctcagacacaccagttgaactctgtttattcattctctttgtccttttttgtgagggggacaagcaccaggtgccaccaataagctatcttactgacatcactccaactggaaccgattatttttttctgagtttttttttattgtagtaaaatatgcatatcataaaacttaccatttcaaccatttttaagtgtacaaaccagttggatttattacattcagaatgttgtggggttgtcaccactatccattttcagaacttattttttttaccatcccaaacaaactaaacaattaagtcttgtttcccccctcctctaacccctgataacctctattctacttttttttcttggtgacttatataagtggaatcatacaatatttgtccttttgtgtctggcttatttcactttttaggttttcagagtttatccacattgcagcatgtatcagaatttcattccttttcaagggtgaataatgttttatcttatgcattcaccacattttgtttatccatttatctactgatggaaacttgggttgtttccaccttttggttattgtgaaaagcgctgctgtgaacattgatgtacaagtatctgtttgagtccctgctttcaggtttttggggggtatatagctaggagaggcattgctatatcatgtaatcaggctatgcttaacttcttgagcaactgataacataaaattttaattcaagaaatatactgtgtttagacaatgattttgtcattcacaaaacatttattgactttataaataggtttaaaatattcaagtagttcacagatgctacatcaatagaaattatcacacataatattttctgaaccatgtggtatttgaactcattcttgagaaatggggagtatctggatatctgaaaacacaggtggaactccagacagaaaaaagattatgccagtctactcccctagcctattttcttgtcacacaaactggctttggagatgccatgctctttcatgaatcagcgctcctgtgcaagctgtttcctctggaaggctgccccctcacctcttctctgcttggtaaattagtaatccttcatgggccaaattaagtatcaactttgacttcccaaggcagagttatatatcccttcctttctacttacaaaccttttgtccatagttccaatttagtacttatggtattattgttagttattttatttttttgctttcatactatattgtgaactcttaaaggaaataattatgtctaatccttccatgattatttgtctaccaactcacccaacttcagtgtctaaccaaggacatggcatatgataggcacacagtaattatggaataaatcaataaagtttgaaaagaaagaaaaaaaggaaggaaggaaatttcctggatggtttctaatgggaaagcagtgtcagtgggaaaatatctatgtctgtctatctatctatctatctatctatctatctatctatctatctatctatcttaattaaagacattaaaacaggatgtcccaacataagtttcatagcaaccctggttatatccagttatctcaaggaatgttttggaaatttatagaggaagtggatcttcctttcattttaatttaaaaaggacgtgatgtcataccatgtttttgtggttgaaaaggtcataaaaaccagtcttttgcagaatagcacagctctctcagtgccaagaatcactgtttagacacaaagatgagcttatcaacagaataacttaccaacaatagttgacatattttcccacaggacagggcataccacataaattgtcacatttcgtggcttttatccttgagtatcttctttgtaagttaatggaagccagctacattttcagtgatgcatgtttacgctcttggatttgtgttggttgatttgccttcattttctttatcatttgaaaattatttatgcaggtttttcatgctttcagttttgtgaagataccttaaagcagtagaacagacacccccacactgtgctttatattttttcaagaggctgtttggcatagcatagctggatgtatgctttggaatcagacagactttggcttcaaattctgcttcccctacttactagtactatgactgaatacattatttactgtctctaaattttaaatttgtataagtaaattggagataattatacttacttgttgggctatggtaaggattcacaaagatatctaaatatcatgcttagcacagtagctgatacatggtaaaaattccacaaatgttaggtctcaaattgtacagttgggaacctatagctccttgcttttctcctgtaccatcagtcatctcaataataggttagttttctccttctgatgacattgttgagtttttctagtaaatgtggattttataagaatgtagatgttatagatcttgcattgtgtttttcaaacgacccctcactaggcatatttctcccactgttaacctactaatgaaataaaaattggtttttggacttcttttaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatctgtgagtgtgttcaatgtaatctctaaatgctactatctgttcacttattaaatagtgtttaaccactgcttcatgatctgttaggaatcaaattattctcacattcacttgaaataaattcagattgatatatgcttttaaaacatctactctttactgaatctttatggtacctaaatttgagctacaattgagaaattgagtcccttatatggatttatgtgtgttttctaatcacaataacttaaaatatattcgtgttcaacaatgtattttagccatcacgatttgtgttatctgatggtttcagagttactgaaactatacttccagtaaaaaataaaatacaataaaaggaaagaaatttatttgtttttttattttgaaataagatctcgctctgtcacttaggctggattacagtggcaggatcatggtacatggtagcctcaacctctgattcttaatgatcctcccaccttggcctcccaagagctgggattacaggtgtgagccacgacatctagccaaagaaaataaatttggctaagtcgtgtctcatttgcggaaacactgtagcatataaggtgtacagaggagtaatttaaaaaaaatttttctataactccatcaggtgcagatttttctttaaaaaaaaattctgtaactccatcatgcacagaactagtaatttcccttattatcttccccttacatctttgcagtatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggtgagtttgttttgttttcttaaagaatatatttttatgtagcaaacctgtgaaaatcatagacataaaatatttgcttactcttaccaagtcattacaataaaaatatatttatagtagttaatttgctcagaattggttttgctgattttttttttcactcagtgcagtttgatgtttgaattgacggcccccacctttgtattctatttcttttaaacctgagttaacttggatggcaggtggatcacgaggtcaggagttgagaccagcctggacaacatagtgaaactttgtactaaaaatacaaaaaaattagctgggtgtggtggcaggtgcctgtaatcccagctacttgggagactgaggcaaggagaattgcttgaacctgggaggtggaggttgcagtgagcagagatcacgccactgcacttcagcccgggcgacagtgcaagactctctctatatatattatatttattatattttatatatatatatatatacacaactggactaggttatgattgtttgaaagtttaagtttcgtatttctaatttagggtagtgttcaacatgtgatactttatgaggtattccaagaaatatttctgcaggatcttgtttttaaaaagccttggaaatttgtagagaaagttccttctataatgtcttaactctgatagactttttaaaatcctttttttcagaagaattataaccacattggcaatgctgagacaatattttaccgcaagccaatctgaatcataaatgaaacaaaataaatgaattcaagaaagggagaaatccaaagtaaatgccaacctctgtcttgcaatttcatagattttgcttaatgtatgattgaacaaaggacagggttttaaattaaaaatagaaaagggtaacaaacattgtaattatgtggattaaagaatttttaaaaatcatctcaaagttctgctaatttagtgtgtcaaacaacaagatagcatgaatatttcagtctggcaactacctagaaatgtagttaatgtctaataatccattcttataacgtgtaattttatattttgaaaaataaaagattatagtaaaaattggctatacttcttcctccttctctgattcccctgtgagaagaagatgcagctcctaaacatgccattggccatgagttagagaactgattaaagacagagtgagaaaatgaaggcaaaatcacttaagttttctccttatgctcatggagcacaggtatgctccaagtgcaaggaggactgtgaaattttatcttgttacattacttggctggttatttcctatgtcactttatggtgaaaagctcccatagtagtttgaagtgtaatttaactttggttctgtcttctatttcagtcctcttatttggtctttaaacagtgcttatatttgaacaaatagagccagtcaacaaataaaagagagtgtagaaattgagatccatgaaggcaggaactaatttcataggcatttggcaacggtaaatttttaatatatgcatgaacatagaatcattcaatttaaaaacaattatttacatataattattttaaaatcattcaaacatttacttatgtttagagatgagaaatgagctgaattgaactctttgtatgtgctagactaagaatgtttaatgataattttcaaaaaggttgattgattttgataaagttcagaacactactaaagggtgctaatatatccataaatttccatttgtgagatggcataccagatgccagccagtggaatactgccagagggaattatgttctatatttttatgtatttcattgaaatttgttctgttggtagagagtacatagttacacagtatgaggtgaatatagcctaaactgataagtcatctttacatagatcagcatactggaatagcaaaaatagtaatatagatgcaattatgaaaaataatatgaggtgaatatagcctaaactgataagtcatctttacatagatcagcatactggaatagcaaaaatagtaatatagatgcaattatgaaaaataatctgagctaatatagcactttttatatatgaacaggagtcaatttgctgttgggaacccgatctaatctatatctgatggacagaagtggaaaggctgacattactaaacttataaggcgaagaccattccgccagattcaagtcttagagccactcaatttgctgattaccatctcaggtttgtttaagaactaaaattagctgagtaattatgcagattaattagtctgcaaactgggttaaagactttctcaggttaaagtgttcctagaagagcactttaaatataacctttaattgggacaccagactttcctacttatattatcttatctatttacaatttaaagtaacttccttttattgtaaagtacctaacctaggttactgataagaaaaaccacaacatttgcatccttgcatgttctctccagtgcagcctcctacaacttcagatttctaattttcatccattcatgcacaggactgcatcaacatccaccatgtcccgttcttgtgaggtgttagaagcaacaaagaacaaagtgaacaataatcagatacaaaagagagttgtccttagtatatagccttatcacaagggcctacaggtagagtttgtaacaagaatggatcccctaaagatctttacaccttttccaaatagtagttaaatttcttagttttggtcagtcagagcctgaaacttagaatacaagaaagcaagtaaatgagtgttaagagtgatcgtgattactaaacagcatttagtatcaggaaagcaccaacattaaagctgactataggcaaaagatgactgacaaaagagagaaaaagtaagaaaatatggtttgtctatgtgaataaaatgatgctaatcacagacacttatatgagtttatgtattttattatatataacatgctttatatataattagtgcacaaattgccatgttgcacactaatgattttgtgttattcctaaaatgattaactttgctttacattttggttagaggagaaatccctttagaggtatgctcagacttcatgattttttaaatcatgttttatagttagttgcttataattgtttaaggtacgtagaagtaatatttattttttgaaaacatctgggtggcttatagactacatatctgtataacagatttctttactttttatccaacttcctctaacccaaatatgttcttctctagttcttgagcttctctcaaatgtggaatatttttccatcaaacagtactgagaacatcagtataagaaggtactcagtagtttaaagcacaaatttattttaccatttaagaaatagaatagcggtagtgttttagtccattctcatgctgctataaggacatacctgagactgagtaatttataaaggaaaggggtttaattgactcacagttccacatggctggggaggcttcaagaaacttacaatcatggcagaagggaaagcaaacatgtccttcttcacatggcagcagcaaggagaagtgcagagcgaaggggggagaagccccttataaaaccatcagatcatatgagaactcaatatcatgagaaaagcatgaaagtaactgccccatggttcaattacctcccactgggtccctcactcaacacatggggattactatttggattaaaattcgagaccatatcacatagatgtagatatctgaaccctaacactgcttcaaaaatgttgtgtaaaaacatatgaaagactaatcacataagtaagaatcctattgttgggcctagaaatcatgtaataataaaccataaaaatgacaaagaaaaatgattataaagtcactatataggggaaaagaaatgtgtgattttttcatggcctgtgtttcctgactgaattgtaagaatttgatgaaatttacaattaggaaattaatattaacgataaatttagttggaggaaaatataatgaaactgttcaactattttacaagcatgctggaatgacagaacacaaagatacccatattgctgtccctgaataccttaacagtcaatattcagccacccctctcgtacacacacactaccagggacagcttttaggtctctgaactccagaggagttatgacttcatgaatagccaaggtacaaatgaatggatggtaattatcttgcctgcatagtggaaggcttaacttgtcccaaaaaaagtttagatccccttctgagaggcacataggtagatactttgactatctcttggaattgagagactaaaataatctgtcatatttccaaatcctgaatgggagattctgatgcaatgcagttttttttaaggtgctttttacgttaataaagatatttttaaaaggcaaaatatctttacttttttttcttctaatatatgaaaagaaagactgattttaaatactgtatattttcttatctatcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtccgtaagccacatttcatgtttactacagctatataaattttgcatcctttcatttggtgaactacataattatgaaaggcaaagcagagaaaggaaacaatttgcagtttcaaatacagacgagatcagggacgttcagggtggtatggctatagacagcaacttcaaatcaaagaagagtaaatttcactgacacatcttccaggtcttctatgttacaatcttgatttttttttttgagaaaacattgactgactaaaatagttattgatgttaggtttggtttacctcctcaccttactttctttcccagtcaccccgaatattccagataaaccgatttttttttcctgcctttatatagcttcagctatataaatggtcttgatttatcttcacaaacttggggagatgcatatgatattctctttctttggagcaacagtaagattgaatccctcctaatactgtccaggaaacttaatgatgagtcagaaagaaaattctgtgatctgctggctctcactcccactgttgatattaatgaatataatcactaattgttttccatctgattagaatgttttcatataccctgtatcttcacaaccatccactgtgaaaggatgtaacaaccctaggggttcagaatcctgctctcagctataaaaaaccgtgagctaatgtcatcccattctgttctatttctgaagcaaatccccctgtactctcagccttcttttgcttctttccctcttcattaattgcctcttcaggcagaactggtggcataggtgagaaatagctggaatcacattatataaattgcaatgggatatttctgtcctgactgaccattattgttctgcatataaagtgactttctcagggtaggtttttgtatgtgtgtgcatatgtacacatacaccactaaagagggaaatgagtacccagataatttaagcattaaataaatacactagtttcttccaggtttaggtatcactacttccctccaaatcatattatgcaaatgtgatagtcctacaggtgaaagatatccccagatgttaactcaggagtttatatagcaaaactacctcctcctaacttgtaaaatattagttcagtaagagatagtcacaaagttactcatattgcaaatctgtgctctttgtgaggggtggactagttaagtttagttttcctggctgaccccattccagtccacctaagctctcagaacagcaaaaagcatttgtcccactgacaggtggaattagtagcatcttcacataggaagacaagaacaaatcatacttgcctggtattttcatagccttccaagatccacaagacagtgaactgtcaccaattactaccctatattaaatatataggaagtgttttcttaagagagaatattttttattattggaggattagtaatcatgctcctttgacctacttgggagcaatgcaaaagaaaatgcaagagtaagctagacccagagagagacagaaagagagagagagagagagagagagagagagagagagaatgcgtagggatggcagaagaaattgcagccaagaaagggctttatagcacaaagtataaatctatcgggtaagacaacatattccataagaaccagaagggctaatcaagagcaagcatatacctatttatactttttaatttaccttttaaaataaccctattgaaataatgtacataccatgaaatacacttgtttaaagtgcacaattcaatgggttttaggaggtctatagagttatgtgacaatcgccatgatctaatttttatcatccccaaaagaaaccccatattcattaacagttacccccattccatccttctttacttccccctctaccactcacagtcctaggtatccattgataaactgataaatggttacctaggactttctttctctattgatttgcctcttctggactattactataaatggaaccatatattatgttgtgttttatgacggacttttacttagcataatattttcaaggtttgtctatgttatatataacatgtatcagcaattcctttttattgctgagtagtattgcattgtatggatataccacattttgtttatccatacatcagttgatggacatttgcactcttcccactttttggctattaaaaataatgctactacaaacatttcatacatcttcatatgtggatatgtatggtttttttctcttggatagtatcgttacactgtttttcaaagtggttgcaccgtttcacattgctatctgtaaagtatgagagttctatattctctatatccttgtgagcacttgtaaatatctgtttttttattctagccatccccatgggtgtaaagtgggatgtcataaaagtttcaatttgcagttccctcatgattaatgttgttgagtatcttttcatatgtttactgaccatttggagacatgtctattcaagtcctttgcctgttttttaattggtttgcttatccttttgctgttgaattgtaaacattctttaagtattccatatactagagtctttttttcttttgaggcagagtctcgctctgttgctcaggctggagtgcagtggagtgatctcagatcactgcaacctccacctcccaggttcaagatattctcctgcctcagcctcccgagtagctgagattacatgtgcttgccaccacacccagctattttttatatttttttttttagtagagatggggtttcaccatgttggccaggctggtatcgaactcctgacctcaagtgatccacccaccctggcctcccaaagtactgggattgcaggcgtgagccactgtgcccggcccatatactagactctcatcagaatatgatttgcaaatattttctcctattctgtatgttgtattttcacttccttgatagtttcccttggtgccccaaatttttaatttttgatgaagcctaatttatcttttttttccttttcttgccttatatttgggtgtcaaatatcagaattcattgctatattcaaggtcatcaagatttatccctatgtttacttccaagaattttattgttttagctattacatttaggtgtttgatcaattttgagttaattttgtatatggtgtgaaatttggactccaaccttattgttttgcataggtatatccgcttgtcccagcaccatttgttgaaaagactgttttttccctattgaatggtataacaccattgaccatagatgtatgggtttatttgccaactcccaattttattccattgatctatatgtctctccttatgttatttagtaccatactgctttgattactgtaacttgcagtaagctttgaaattggaaagtgtgagttctccaacttagattttctttttcaacattgtttggctattaggagcttcttaagattccacgtgaaatataggatcaacttttccatttcttcaataaaaggccattgggattttaatagggattgcattgaatctatggagacaattttggaccgtattgctatttcaacaatgttaaatctacctatctatgaacaggaaaactttttccatttatttgggtcttctttaatttctttcatcaatgttttggtgtacaatttagagtgctcttgaaggcgaatatgtatactccataaaactatacagtaattttgttacctttttgtgggcatcaaattgtaaccaagtagcttccccaaaaatatactgtctgtgctcttaaattgtggttatggcattttttatgacaaatacaaatacttgagtgttcttgttaactgtggcatcgttacttttttgtgttttatcattatagtccaacatgaagaaacaacatatattgcaattgctttgaaatcatcaattcacctttatgcatgggcaccaaagtcctttgatgaaagcactgctattaaagtgagtgagctcctttttctttggattatatgattttttattttgagaagaaattgtgaacagaatcgtaccttggaatacagatgcagaagtatataccattcttctatagttaatgaaattttgttgttagtttgcttgcttgtttgtttgtttattttttagatacagggtctcactctctcactctggcccaggctagagtgcagtggcatgatcatagctcactgcaaccttgatctcctgggctcaagccatcctcccacctcagcctcccaagtagctaggactacaggcatacatcacacctggttaattttttaatattttgtagagatggggtctcactaatgtaacttgaatataccatgtcagtaattactgtttaacccttttttagacaattcacaggcatcacagcaagggagaatgcgagggaaatccctggcccctccccttataggacctccccaccagcgcctcactcccaattcctgtagtcaatatgaagaccttctctttcagagcctcaaacacaggctttgggtgccaccccaataaattgaagctgagaaagtccctgttttctcttagtgggggatagagagcagagggaaggtaaagaaaggtatggtaatgatagagggggaacacccttggaggaaaaaggagggaaaagaaagcctttgctccagttaccatggccacaatatgtgggtatgggaaggggttggatgagtctatattctttccaagctggaactctaaacacatttctctctctatctattaatattgtgagacatggtggttaggcttaccagtactctttctaactttattacagtttggctgaacttctatggataggccacataaataaacaattgagtgtcttaaacaactaaccttaaaatgagggactgtttttatctagagtaacttacttataatgctccagaattctacttaaatggaattattttgtatttattccatagtaatgagggttgactaaagaactggcagcattctatcatgtccagtagcttctaacctaggatgtatatcagaattagctggaacatttggtaaaggtttagatctcagacccaacaccaggctgaattagtgggtctggagtagggtctgggaattgatatttttagcagatgttccaggtgatttttaactagttgatccatagacaggttttaacaaagcactgatagggacccatcctgacagacgcagcaaggtattcatgaaatacttttgtatcttaagtcaggatctgtttacatggtatattttgtaagggaacacatcacatgtatacaataaagatgagcaaattcttatgactacctgccaatgtctatttgcataataactatgttcttctataaattatacagatgactgtatatacagtctgagtcaaccctaagacaaatcacgtcacatccctgatctgatctccctaaattgggccttggttcagctgtcagtatttggatatgggtttattcttgggtgtctgctgattggtcagagctgcctggtatggagctggaaagcgaagaaataagtaccaacagtctgtctagcctgatacacagttcttgtccaagtcctcactgcagttcttgactcccacctcacaactacagtatgttgaatcctgtgatgctcagtcctctaccgtgatctgatcttggcaatgaatcctgtttggccttttgttttggactagaaaccataggagcctagagtacatacccagtatatggtaggttaacatgtctggcccttttcattccctaccaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggcaaggaacttgaagacagcaaacagaatgcagggtcatacaaggctcttatgatcattgccaatctgacctttgaagagaaactcaatattttgaagctattgaacataattatttctttgttgtaataacaggtctaagaaaaactgtaatacacaggtctctaaatacaatatgccattttaaaaatccacctgggttttgtacacttataaacctgacaaaagagtgagggaatttttgccttagttagaatgtcatttttggccttttggccatatttggttttatattcacaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatgtaagataacaccttcagattcctagaaattattgtataccaccatttgagtttttccaactgtcaaaactctgaaaggtttaaaaatatgattagtaatgtctataccggaactgagacataaaaggtaagtatagagtgccagaaagtggtcttgcataaacaaaaaacactgatgattccttagtttagaaagctgagtatattctgcagatagattttgcttgtcttgcctaatttttttttatttttaatgaataaagtttacacttaaactctggacttctattgctacatcagaagaccagatagcatcagtgccacattactatctagccattatcaattggaatgtattcattcatagctccttttagatgggatatgtgctctacattctctacccatttatgtttatatatttataataactgaccataaagtgtatttgattttgcagtacttgctttagtttttctgcacttcacaatgcattaacaaatttttaaaaaatacaacaccagtattgcagcattattatgtgtattcctattctttattatattacctcaacagtgacataacagcaaattatcataaaatgttctcttatctggttaattatagttagaatttctgatcaaaagattcagcattttaaaagcagatactcctcaactcttaaatgcttatattttgtgaaatacggtgcaacacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaaagaaatacggtgcaacatctaaaatatagattgtcataaaaatattatacacatcatttacataaagagtttgaacataatgtaatatccctcacacacaccatacaaaatataattctactgtgtctcaaatttgatgttggcaatgatgtttgtcctattgaaatttttatttaaaaggaaggcctaaaccaacagttctctgcttcactatatttaaattcccaatttttagacaaccaaagttttagcagtttagcattatacaaaaagtccaggagaaaactttgatgtattttcaaattactacagttgtgtgatattttgaacagctctcagaattgtctcatatgtctctaacaaattacataaaccaattgtcaggacattagtggggacaattttgtaaaactcttttggtcatattaaagataattagcttattactcagttgttgcccatgattatatagaaatcacactgttgataatgtataaaatactgaaccaatcttagccaaagccacttaaacgtgaggtcaagttaattttgatatagctattgttgtactcttcagttggagtgtcttccgtagcttcctgcatctctcttttttttttaaatgttgcgtcagatagcttttattaagaagctagtgcagtattgaactttgcagcattggtccatgtttacacttatttgaaaagtaattcaggaatgttgacccgcgtgtttcacatgattaataagcaaggaaagttatttccttttgaagcaatttgttagttagagatgagttcttaaaaatcactttctgacccaattaggataccttgtgtatattcaaaaatatttttagctaaatactctagtgtcttgacccatttaaagagaaaggactctaatatcagggaggggggtgtcttctgagaaagaatataataaaaatactatttttccaagagtgctagattacaaaagctgtaatgatacaagggaaccatgtgtgctaaagaatatctagttacttcaggaatcatctgagaagcatctgaggctgtatggatttgcagcagtccagtttttttctaaacagattttattaagacaaccttctttcctgcaatttcttttactctcttcctttatcttttttttctgattcaattgctcatgcaagtgcccagggaacgcattaaaattgcttttcgtctctggatccccattttagttataaggattgttgttgctgggacatggcctcaagcacctggcctgagtacgctgggtttggcaagtatagtttctgacttttttttttttttaatgtgctagtttgaagaaaccatagaggaacacaatttttcatttgtagggaaatactgttaatgtgacaatatctgtagtttaagaaaactttattgcattgttttatgcatcatgaaatttagaaatgcttagatatttcttagtttttcatattatgtcaccaaatatgtctttgaatgtgtatcttaagtgcatttgaaattatattaattggaaaagaaattctaacttttttgcaaagggggaaatgacttaaagttatatttcaagctgtgaagactattataaagctgtcccttgtaaacattttaagcttaagctattttttagattagttttctatttctaatttgagtgagttggctgataagcaagtattgtatatttgttatttgatttgtacattaattactaaagtatttattaatgtgttatcttaaacccaagtctataacaagtagtgtttcttctattatgatacataataatttgtgaaatgtcaagaaatctctttgtgttggaaatacatctttgcttttttaaaataaggctttctcctaattataaagaagaatatttaacagttatgaatttatgacataaagaaagcagctctcttcaaatattggatagcatgcttattactttggaaatagaggtttctcttcctccttgctctttgaacctcttttggtctttattgctctgccaagctgcttcgattaaagtagtagtgataaaatattggacatataaatctttatgaaacataattccagcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctataggtatgtatacaatttatttcttcttcaggaccccagagaaaatttacaagggtaaaaaagtgtcctaagaaaagatttcctgaattattacattttcttaagacacataagattagtttggggttctgcataattattctcttagtaaggtgatgcctgtatttgtcctatgcttaatgaattcgtgagagtaccacaaagagactcattttggttatctgagttatttgcaatattgtataactgaaatgagagctaattcctttccacaaaaatctataattttgttttaactccctttacttgcagactttacacagatattggaaatgcttcttttcatcacactgattgtggggtttatctttatcttaggagactgccaactagtataaaagagccaaatacttctattttttatagtcagtagagttctattttgtgagtgatattcctgtgaagaatcaaatcatttagaaaagtgacagatatgactgactggagtgcttgttaggtaccaaccacgtggcaacaaagaaaaatgccttttcaccttcatcaaaccaggatatttttttcttcctagccaaagcaggactgctgatctgagaaatccaaataatttgagattcttgtatatgttctgaggctcagtgaccccagacgtgattctagatagggaacataatgcatacaaaaagtaaatatattagagagagtagaatgattagctggaggatagctattatagaaaagagaagtttaatggagaaaataaaggaaaaaggcagcagtgtgtgtgtgtgtgtgtgtgtgtgtgtgtgtgtgtgtgtgtgtgtgtgtggagagagagagagagagacttaacaattgcatcagatattactaagtgttcccatttccaaaacattgtgtcccatctcagaaagcaagctagctcagtagctaggttaagtggcagatgtaggtgttttgggactaaggtggaaattatgcgatgtcatatgaactatgtacttggactcagcaaaaagcctttgctttaggtttagaatttttagtctatgttgttgttgacaacatagagacagagagagagagagagagagagagatggtctgtcaaatgagaaggcagatgcttctgagatctctataaaatgactaaatatgatcctcatgtggctttaaggaccattttgaaagaactgctttttaatgaacattttttatatgggatgatggcactttgcattgcatctgcagaatccttcttctttttttttttttcatatatagtcagtttaaggattgtcctgaaaacctgctccaatttcctcaaacaagtaagaactcacagaggttttaaaaccactttaagtgacagaagataaatgcttacagtataattgacagattcggggcaaaagaaagtaaaaataatgactcatgttctatcctttacagtggtacttttgtgatcgatatgctaatcagaaatggttataaggaaattcagttcaaataggaaactgaacaaacccttatatttatgccagtagacaatcataagggtcaaagggatcttgagaagtcatctggtgcagctcttgtcctcagacaggacaacttctgacctaaaacaaaaaaaagctactttaagttgctagaatttgaaagacagctacacgtaaaataaattacagtactataagaacatgatactttagtttgtatattaaggatattttgagagtatgctaaagactgtcatataacactgatattaaggagatcaattactgtattattctgtctacaaacaactgctttgttatttaaaactaattcagatccagatttccccaatttaaattttatgttttcttaagttataataaatgtgttcaaatcattgctctccatttccaaacaaatatgtacaggcttaacaattgcatcaggtattactaagtgttcccacttccaaatcattgtgtttcatctcagaaagcaagctagctcagtagctaggttaagtggcagatgtaggtgttttgggactacggtggaaattatgcgatgccatatgaactatgtacttggactcagcaaaaagcctgtgctttaagtttagaatttttgatctatgttgttgttgacaaaaatatcatttttaataaagtagtcacataggtgaagaaattcaactctagatagactagatctgttacttgttcccaaccctctggagactgattttccttatttcccttatatctggagttattttaattctagtctgaaatttgacttataaagtcttcttccaggataaccatttttcttagtcaacttattccttttataatagaaaaaatgaaaaatcaaagtaattaattgaattctgattttaatcatgttaatatgagaatgaagatgccttattttgttgtttcctagactattttaatttgagtttaaaatcttgatattattttaaatgtcaggattttatttacttatggaatttttccccatgaagtacataaagaatattaaattgaaagttaaaaatgtaataatagtgctgttccttgtgtcaaaaaataccttgcagcaccagctgactgactgtttacacaattaggtttaaggcaattattgtcataatctatatttgtcacaaagtattataaaatagagtcaaaaaagttaaaatcttaataaatatttcctgagcaggaaaaaaccttaagaatatcaaattagctttggttctgcttacaacatgataatttattgaattgcattagggttgctacagtcattatttgagcaagtcattttttaactattttaatttttgagagtcaggttttcatgtacgtcactggagcacaaatatacacccttattaggagcccttattaggaatgctgtatgtcacttagactataaaatgaagagtggctgtgagtagatcacaatgtctacaaatgggatagaattagttcttagctttttctatggtcttagaggatatgaatacaagaattaaataactgagacctggtaattaaatgttgattacaatggtgcctttagatagccagtttgaacaccactcttgagcagcaaaatggccaaacaactgactacaggagggaaaaacaggatgtgctaacctgaactgtaacaatgagcctcttaataaacaaacattgactgtagttataattttctatgatggccagaaagattttgtgtttttctgattttttttcatttgtattgtagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaaggtatagcttacaccctccagttacagcaaaaataacgcaaccattgaaaatgaaccaacaaaagaaatttctgtccttttccttctggctataaatatatttgtggtatattttttcaaactggcatactattgattaaaaaacaattttatattttgcagtagaaacgctaatttggtaagtgatgaaatttggtttcaaaagaagctcattttgaaaaaaataagaaaaaattctagttatgtcttaagcaaagcttagccattattttatttggttcgaaatcctttattgtctttgattcatagtacctttcatgttcatattaaaatgatatttttaaacaaaatgcttgagcaaatctgccttttatagctttcaacataattcaataacagaaggaaaatgtacttatgtttactgagcacttaattgtatagtaggccttgtgctagatactttaacagctatctcaattgatcttcacaagtgggtgttatgatgtttattttgcagaaaataaaaataaaatcaagatctggcaattatttgtataatttgatcaattttaacaactaattcaaatagtttagatggaaaatttcatggtgtaagattattaccattcctacctattataggaaataatagtgtgaagaaatagtcctaataggattaggaaacattcatgttgagaagagattgcagagggtttgagttaatatcagaacagccagggtaaagcactgtatgtcaagcaaagttgccaacttacaatgtgaagagatgaaatggcaaaaacctgtgtttcaggtcagcgagacctagaatgcagtcctggctctaaccaggactaaccaggttagagaacctgagaagtttgattaatctttctgatccttagttccttcatctccaaaatagaaatattaataactgctttgggaacaattgtgacaactagtcatatctgtaagcatctcacagattgcctgtaacatcagatatgttaagtcaagaatgactagcatatcttttaaaaaaattacaatgttgtctctttattatgaggtaaaatacttactatgaaatgtaaaatgctgttttcatatacacttaaagccctgcatccccctctgtatagagcaaactctgtaaaggtttatgaagatttttatttaattgggtataaagcagatcttagaagagttaagcgagggcattttaaattttatttaactcagtataatcatataattttttcttaaaagattatttgttttcttgatgactactaaccgaagtaactatgattgctgcctttgtctaataatattaaatatttttaatatttaaattttaataatttcaaatattatcttttatcaagcaaaatgtacagttacatacactgtaagctcacagtatcacaaattagagactccctgcttccctttgtcacacctagtgtatcttatcatcatcattatgtcacaaaatctcctaaatatagccactgtggatgtcaaaagccttagtcctaacaaggagacatttgtttgatatttatgtgcatattttgttataattttctttatggtacagaccacatttacacaacatgtccctctctaagccactgggtttaactcattttatcaatctattgatgtccattttgctgagatagaaaattgcatgagtggatgttaagtgctctcaccataaaaatgataaccacatgaggtgatacatttgttaattaacaagatttaacaattccacagtgtatatggacttcaaaacatcattttgtttgtgataaaaacatacagtattatctgtctgttaaattttttaatattaaaaaataatgaaaagaaaaaaaaagaaaattgtaccaagtagaaaatttcaatggcttcttaaatataagcagcaatggtaaacaacacctaaataatttgtttccttatattaaaagaaaagccaactggaatataagtagattattgttttaaaaagcaaagaattattgcccaaaaataatcaagaacttcagcaaatgaaggccacctacgaaattactaattttatttaaccatataaattataattatgtagactatagtaaaagggttgttttaaaaatgtataaattagacttcaaactaaagtaaactcattctttcatttgaaaaacaaactattccacaaaacagtaaggcttaatatcttaattagcagatgcagataaaattatagttatatgaaatatctggttgcaatgtattaaatatctgttgacagtgtatttctttctttttcaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaac

SEQ ID NO: 4845 - DNA, 96411 bp, human; identical to SEQ ID NO: 3546

SEQ ID NO: 4846 - DNA, 103155 bp, human; identical to SEQ ID NO: 3547

SEQ ID NO: 4847 - DNA, 73465 bp, human; identical to SEQ ID NO: 3549

SEQ ID NO: 4848 - DNA, 27378 bp, human; identical to SEQ ID NO: 3550

SEQ ID NO: 4849 - DNA, 71304 bp, human; identical to SEQ ID NO: 3551

SEQ ID NO: 4850 - DNA, 47142 bp, human; identical to SEQ ID NO: 3552

SEQ ID NO: 4851 - DNA, 12499 bp, human
ggcatggctgcccttttagcgtgtcccagcctgccaagagggagtgccctggagagacccttgctcaggagcactgccaggggatcagtgccccatttgtacctgcaaggtagggatgggccgccttgggaaggaggatgatttctggtttgcttcactgagttcaccctaggcaacaaatccgactgtttgctttgatatgacttgaaaaatagagtcaagcataatgactatgaggcaagctctagaggtggccaggtttggtacccaggccttgctctgtactagcacagtgagaccatggataggaaacacctcagcacagtgcctggcacctagcaagtgttcaatgaaccgtggccttatcatttgtacatgggaatccttgggagggagttggtgttgtacactgcaaagtttgccaagctagatatctacagacctagattccaagtctaactattactgctcaacttgggatgttgggcaactcttttcatctcattgggccgaggtttcctcatctggaaatagtaatggctgtcttatttttgtaacatgttgtattggcctttaaaacatgcacactctttcacctagcaattctattcttaagactttgtcagtattatgtgcaaagatgctgggttatagtgaaaatgaaaataacaaaacgtctagtagtttacgattaaataaatcatattttatatgatagaatgcagtgcagccatgacagaatgatgtagttctgtgttttaattgacatggaaataggtccacgatatgttatttacaaatgatgtaaggttacataaactgtaggtatagtgtgattcaattttataaaacaaatcccatcgatatcttctacaatacatcaaaatgttagcaatgattatttctggctggtggcattatgaggacctctattttcttctttataattcattttctgaattcttttcaatagcatctagtatttttctacttagaaaaaactagaaagcttttttgcgttgggagagtaaagccagtcactgcgctctactactccacagcatgtttttttgtttgtttgttttggtttggttttatttctgttgttgtttgggtttttgtttgtttgctttgcttttttgagatggagtctcactctgtcacccaggctggagtgcagtggtatgatctcggctcattgcaacctccgcctcctgggtccaagtgattctcctgcctcagcttcccgtgtagctgggactacaggtgcgcaccaccacatccagctaatttttgtatttttagtagagacaaggtttaaccgcgttggccaggctgttttcgaactcctgacctcaggtgatccacccgcctcggcctcccaaagtgctgggattacaggcgtgagccactgcacacggccttcacagcacttttgagaggcttaaatgacatagtgcatggcactgccatgtgtggtaaaaaggagagccctgtccttatgctggcctactcagttccaccttgtaggacctgctctttgaactcagagtctgaacctacagtacccatgtttgcccttgagccttgggaccaaccttaggggtggggtagggctgagggcctgccagagaatcaagctgagtagaaaagtctatggagctgcaggccatgcagggctgcttgggcactggctcaccagggctgtgtttatgcagcttactccctgctgggcttcagggctgctagccagggacacctaattggtgggacagagccccctcctctcaccaccctcaaagctggaatgttctgaattccttcttgggccaaatccccctccccacaaggcctctcctgggttcacagaggtcaccacacaaaagcccagctggagtggagtttttgacagaaaaaaaaaaacacacacagaaaacccaccaaacctttttttttttttttctaaagtgcctcaatctttcccagcctccaggggtttaattctgatctgtaataagtctctgacccacggctcagatttgcagatggattttgcaaagctgtggttaacgattagaaatcctttatcacctcagcccgtggccccttgtacttcgctcccctccctcaggatccctttctccctctccaggggcatctccccctccaaggctctgcaaagaactgccctgtaagtatctccatcctgatatagttgctgccttttaaattcaccgaggtgggcactcttccttcctagtcactatccattcaccccatggtggagccaggctgggccaccttgggtttctgagtgaagggtatgggaggggaaactccggtggcatttgggttggtggtatttgttccctcaaagctatcacaaaggttcaaatctttaaaacttcaggaccagagaaagcactctccaaatcagatattttctggtttgggggcttaaaaggactgggataaaaattggaggaagggagccacagtttacccctctgcctaagtgtaggggactgaggagtggcagaaggggcactccctcacagccagctccagtgccctccttggcatgaaggctcagggaggtagcagaaggtgggttcctaagtgaagtcataaagtttccccatgaggtccttcaaggactctccctcactggtctgcaagtctgtcattagaaattccttctttcgactgaggtattactctcttcaagtgccctctttgaaaatgcagttggaaccaaaacattcacagcacttatggccggggagatcgtaggcgatttttgttttctaaattctgcctttctgtgttttccagtgttctaaagtgagaatgctttactttgatgatcaggacaaaaatcaacttctttttcaaacaataagaaaatctctcaatccagttgcaattctctgaactgccatcaatcaattgatgtagaaggaaagatgaactgctctaaggacaaactttcaagaaagtagggcctcaagggaatggctttgccacctactagtgcccttggcagctggaagtgagtttcagagaagggggcaagtgtctcagattcttatgaggggcagtgagatcaagggatatagaaatgaggctgactgacagaagagggctgtggtggccatcatcacccccagaaggccacatcagttccttccttgagcctgggaaccccaagtgccctgtcccatgtagtcttaggagggtactgccaaagaaagagtaccatgcacaagactcttggagcaagagatggggagaatagcagggaaagtacctaggtgagaaggggttaagtcaggagctgcggtcaatcttgaccctcctaatcctctcctgcagctccaatctccccactagggaagattaagtaaggatcctaagttaaactttcttgcccagtccttgggccatggagtatgttggccctatgcccagaagacaaattcagctgacaaggcctagagtcctctgtacctccaacgcagccagtacttgacttctaggaggatccctcaaagagaggcttctattaaaactggctgcttctaataacagctcttcagtcttctatatttgtcaaagtggcttcctgtccccatgcctttatttgagactaaaaatcttggagatgacaaactagggcctagagaagctataggacttcctcagcaggttctaggcagaactgacacaacaagaagctagatcttttgattctaacaccaggaccctgtctgccctcacctctactgctcatcagacaaacaaaaacctggctgaatccagcctgtctcaccacccaaccattcgccatttagctggtcttcctaactctggtggaaagctgaaccccccctccatggggccatttctatcacttgaataagctccaataacttgttcttcctcctgcctgggcatgctgctatgccaagtcagactctagagattccaagcctcagtaatggcattttcttgactctgccctctccctcaccccaaaacacttgcctacttactactacttaggacaggctctggggagaggctttcctcttggggacactgttgattcccttgggaaactcaagcttgactcttcagctgccatcccaggaaggctgaagcaggagctgctcctctgggaagcagtaggtcttccccttgaaaacctcaaggtatctcaccaattctcactgaaagctcagatacaaataggaggaagaaaggaaaagtattgaacccagcctgggtgaggagcagggagggcccaaggatggtttcaaggcaaggatgcatcctcaaagatgatttgcaattatccaagcaaatggtggatggtagaatagcatgcttacgggcttggagacagagagaaaggcagtcagagaaattcaagtgcttaggtttggctggatcatatgtgtatgtataggagcataaagcatgaggttggaggttaatggtgtgagatgaggctgtgaagaaaagccggggtgaaataatggagggctttcttggtttcctgggctagcaagtttgaacttcatcctgaaatacttaagagctctgaagatttttttttttttttttttttgagacaaagttttgctctatcgctcaggctggagtgcagtggcacaatctcggctcactgcaacctccacctcccggttccagcgattctcctgcctcagcctccctagtagctgggattacaggcacatgccaccacgcccaactaatttttgtatttttcgtagagacggggtttcactatgttggccaggctggtctcaaactcctgacctcgtgatctgcccgcctcggcctcccaaagtgctgggattataggcgtaagccaccgcacccggctgagctcctgaagatttttaagcatggcaaagcgtgaggtgaaagtcacaatttgatttcaactttacaaagatctttgactactgggtaggtaattcattattgcaggattggggcagaagtggaattagagagatcaatttgaggtgtctatgagattttcaaatagacaagaaacgatggttgcatagtctgaactatggtttagggcagtggcgacagaaagaagtagatggattcacagtctatttttgaaggcagacctgatggtacattataattaattatatgtcaacaagaggtgaaaaagcaaggatgactggcttgggttattaactcagtgacagccccactgaggtaaggaacactgcatgaggagcagtttgggcatggggagcaaaaagggcagatgattccagctttgcaaatgttgaatttgaggccattaaaacattcaggtagggccattccaagtaatagttaactacacaaatcttgagttcaggagagaaatctgtggcagagatatgaattcaggagtcactggcatggagacagagaggatgagataacccatgaagaatgtgaaggataagaagagccatctagaagtcgagatgaaaccctgaggaggctagaggggcagagatggatagttagacttaaagagtgagcagaagaagaggaacttataagggaaaactagaagaatcattttgagaagtagttaaaatggagtggtgttacagaaaacaagggagaagatagttttatgaaggagagagacaaggtgagatgacagagatatgatcattgaattttggatcaagaaaagagttgataactttggtgagaatattttcagtggagggctaatggtggaagccagactgcagagggctgagcagtgagtgggagggtgaagaagtggagacatcaataatgaatggcttgtttaaggatcttggctgcaaagagaatgatcaagataggagtaatagctgcacagggaggaggtagagtagggagctcaaaaagtagtagtaaatgtttgaagcagtcatcagaagggtgcttaccagggagaagtagaaggatttccaagcagcactgaaggcctcaatgagatacatagtcatgatcaggacaggtacaattgtgccaaggttagcaataagaaaccaatgtcaagaaagacttgctaatgagtgacagaggtgagattcaaactatgtttctctcccttcatcaaatgtttatcggctcctgctctgcactgctttgcatcaacactggcattggtgtttccaatgctgatgaatcgtattgactatcaatcatgtgcccaatgctgtggaagcatgatagacatttaatatatattttttcacccttaaattgtttagaatttggttgaggagacaaaatattccacaaatgcatatatattataaatatatataatatacattatatatatacatagtgaagctctgctgtctctctctccccccttacctctttcttcctctgatcccccatctctctctttcttctttcccaacgttgggcagcacttcaatgacccttacactgaagcgttattgactcatttggaaagtccctatattttagtcatatggagcccctcaaacctctttgccaacttcattcatttattaagaagacagtttttgaattgctgctctggataaagcagtatgtaaggcacatgagatacagagatacataagatatagtcttgccctcaagtagctcacaggctaatagggaagaatgagggtttaaacaggaaattgcaacataatgcaaaatgtactatctctgcctcagtttcttcatctatacaatagggattattagtgcctaccacaaaaaaacctgtgacgactaaataagttagcatgtaaaaagtgcttataatggtcccataagaaacactacataagtgttgctattattattattactatgatggaagtaaacacaagatactgtaagaatagacaggaggggtacttgacccaggctagagtaagagacatctgtgctgaatcctaaaagatgagaaggcactaaacagaggaagaagaatacataacactctgcatagaatattctgttctatttctatttgggagcaaaagaccacatggcatgattgaagaactggaagtaatttaattccacaatagtacagactatgaggagggaaatggcaagagatgaagcttgagaggtcatggggtaaaccaagcaagtttggactttactttttagcaaatggggagccactggaatgctttatgtagagtagtgactcgatcagattaatgtgttgaaagatcaccttggcaatgatgtggagaatgaattgggagaaagacaagttagaaagctgttgctataatccaggtgaaagagaatgatgaggtcgtgcatggtggctcacacctgtaatcccagcattttgggaggctgaggtgggcggatcacttgcagtcaggagttggagatcagcctggccagcatggcaaaaccctgtctctactaaaaatacaaaattagctgggcgtggtggcgtgcacctgtagtcccagctactcaggaagctgaggcacaagaatcacttgaacctgggaggtggagattgcagtgagctaagatcacgccaccccactccaggctgggcaacaaaagcaaaattcggtctcaaaaaaagaatggtgaaactgaactagggaagtagcagtggaaatggagagaaaggaaccatggatttgaggtatattcataaggtagaactggtgggacatagggactataggatgcaggaggtaagtagaagaaaggtgctaaagatcactttccggattttggtctggcacaagtggatggatagaggtatcattcagtgaacacagggaacacagggaagaactgtttggggaaagctgcatgggggatgtgatgagttcacttttggacatgtcaaattcgagatgtctatgagatttccctgtggagattctgactaggtgattgctctgccagtcttgaagctcagaagggtctatcctggaaattcagatttgggagggtcagtggatgggtagtagattaagttatgggggcaagatgagtttgctcagggacagagtgttaattgagaaaaggatggacttctgaggaatactcacatttaagagatgagtagggaaagagaaatcttgaagaaggctaaaatggaatagccagattgtggtgggttgaaaaattagtgggttagttcgggcacggtggctcatgcctgtaatcctagcactttgggaggctgaggcaggtggatcacttgagcttaggagttcaagaccagtgtgggcaacatggcaaaacctggtctctacaaaaaatacacacacacacacacaactagccaggtgtggtgatgcgctcctgtagtcccagctacttgtggggctgaggcaggaggatcacacacacacacacacacacacacacacacacacacacaactagccaggtgtggtgatgcgctcctgtagtcccagctacttgtggggctgaggcaggaggatcacacacacacacacacacacacacacacacacacacacaaactagccaggtgtggtgatgcgctcctgtagtcccagctacttgtggggctgaggcaggaggatcacttgagcccaggaggtcgaggctgcaatgagccgagatcatgccactgcactccagcctgggtgccaaagtgagaacctgtctcaaaaagaaagaaagaaaaattagtggatcagagggtcttgtagagaatggggaggtgtgcccttgacccttagtgtcctgaatcttggcaacaccgagggctccttgaacacggcaaaatcttatatggctctgagattccaaagcattgactcagatacctgcctcatgcaaagccctatattctagagcagtttccctttcctctgtggcagactcttgtcccccctaacagatggcccagggaatttcagggccccctctcagtcctggaacccttgttccagagtgctccctcatcatccaagaggctgatgatgggagcatctattaggagactggacaggaaatgtctgggcatgttatacatgcaggaggccttagactaggctgcagagggggatttgggcatggctgggaggatctgaactctcagagtatggacagaaggctttgctgcccacccccatctaccctggagtagattttcaccatgggcagaatgatccagggctaggccactactctctaggcccctggagattcaagaggcctctaacaaactggagtccaagactacattctaggatctgttcctcctgatgtagtctgcagtttggcctcagtctgcaattgaggggccctatggcactgttgcttggcaatgtattaaacagcaggccttggagactagcacttgagttaacacagccaccacaaccaccactgccatcatcaccttcccggaaagcagccacctgtctggctcctggctttgtccagctgccaacctaaggcatgtgcctacgcaggaggcgatgacattttggctccacgttcaaagttgttttttttttcctttctcatgtgttatttctaaagataacaaaggtcaaaaggcatccagcgttttctggtttctcataagcttctggtcaatatttaatctggtttatggattttttttaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattg

SEQ ID NO: 4852 - DNA, 30695 bp, human
ccagagcaagccgattctctacacactgccttcccttcctgtaagactcatcaaaaaggcaccccaaccttgcatggatctgctgttggtattccttggggtgaagccagaagtcaggctttccacagagagacgggactacatggccacctgggaaggctagggagtcaaagggcctgaggaatgactacttccctccacaagggcattccctgccctgctctgcttcctgggggcttcagcaagccttccttctagagctcctagaaccctcccatggtcaacacaacagcagcccagacaatgagatgcaagaggcctgagctcacaggccattcaggtaagccagggtgagctgggcagctagatgacccaattttcagtccagaaagctctatctgctggactaatacttccggctaactgatgtctgtgaaaacttgccagacaaactgaaccccaatcagactctggctgcctccatttggataggttaggggtgaggaagggggatgagctgtggcgctgtagggtatggaccctggtaccctcacacacccttctggccccttttcattggcctcctacttctcttcttcatcctcctgctcttcatcttcctcttcttcttcgctgtctgagtcctcgtataggttgatggttgcctggacaggaaagttctgcagtaaaatctccccagcactgtacagatagtcgaaggagcgggatttaggccagaagagcctgtggacagagaagaaacatggcccctaacaggtgtcatatgtgcagaggggccagtagggccaagaaagaagctggcccctaaaccccttctcttggctgcaacaatgaggtcagagggaaaggaagaaagaaagttttgtaacagaaccttctgcattgttacaaagtggccccacgcaggaaggtaaacccttatggacctatagtggttgggtcgggggccagccccagcatctgtcacttatggctctgactccacctgctacctaccccagaaagcttctagccaagaattctccagccctatggccccatctccttccactgaggattatttcactgacccatccatgggggatcattcttgggcatcgttaacaatgcctctagaaaagacagccttggcaaagtcccttaacctctctgggctccagttttctctcctatgaaacagcgatcatagatagcaattcctcccctctcctgcttcacaagacctttgtgaagattcaaagagctaatggatctatgtcaagtttggagcttcatgccagaagcttacctgacagggtgatggaacttggattcagccttggtgacctcagcagccgttgccccaccagcagcctgtccaaagcaaaagctagcatgtggctcaaagtacatggctagataacttcctcctctgtactagaggtcagaaagctgcaggtaaaatgatcttgaagagaccttagacatctctgggacccagcaacccccaatacccacccctcaacaaggggtctctcttggttctggttgaaaaacaagcagacagagtcctgcgggttgtttgcttccctgcctctgttccagcacctgtttggaggctctccaggggacagtgttctactggagcagcaaagattcagggagatcgggtgggtgggagagcactggagtaaggtgccaggagacgaggcctcaagcaccagcactgccacacactggctgtggggcctgcccagatcccttgcccactctgagctttggtctcctcatctttccaattgccacagaaagcttggatctgctctctgttggaatcaaatgttggcaaaactgtgaggatgctatctcagatctgcacctttggactgaggtcaggggctctctgggaagtgacctggtcactgttaatgcatgtggctgcatgtgaacacacgtcacaagggctcgaactcaccaaatccaccagcttcctcatctgccttggggagtcatttgtggaagacagccagggcctccagagacaagttcctctgggacaaagaggagagatcaatccgtagaggaagagactgaaaggtgggctccctgagataacaagagacctcccaaaagcttggctcaggtgccatctgctccaggaagcctttcctaaggctcctgagcccattccaggacagatgtccctcctctcggcttcagcaatgttattattgcttttatcatgctgttttgtaattgtctatttacttgtctttgggcttcttaagctcaaagatatgctcaatcgtatctgaatcctcaacacctagtacaatgtctggtacacagtagctgtttcagtaaatgtttgttgaagactaaatgtttggagtaatgagtgggggctagatggaaaatatcttgcctcctacttcctgctccaagatgtagaactcagagctctaccatcttcctgggctgaagaagagggccagaaatgttcctgggtccactgcttccccactggacttgcagaggtaggaaaaaagcaaatggaaatcttatggcgtggtcaggaaaaagacaatgtcccagtcaagggcctctttagactttggtcctctttccccaaactccccacccccacagtctagattgtgttaagcccaggtttcatggcagttccccatccccctcaggggactcagccacctggcctatgaggacctggctgcttcaccttcagctttggcaacagctgtccccaagtcccctcttgccacccagcgggattagtgaggtgaaaagtcagatgagatattccagctagagttgaggagggagggctatgaggccattgcttttccccttcacagagaacagggtgccctggacatctcattttccttcctctctcaggaagctctcaagcctaagttcaggttgccaaaggctaagctcaacttacctttcactcccatttacttcttgtccagaggagagaaggcaagatgggcttaacaggccagggagtgccagtggggcttgtgctaggtctggagctagggccaaagccagggctggaacaggggtggcagcagcagcacaggcagcagagtccattcttaggggaccaaagccagtggggtctcctacttcccagaaccttctgcactcttttggcttttcctgggagacccttttataagccctgcctggtcttataaattattcagggaggacaggggtgggatgacttgggagggggataaagatttagggaaggggctcagggagggaaagctgggttacctgggtgtgaaatctctcccagttgaataaacatggtgtcagtgggaggtgagggatttgctttgcctccaagtcagaaagaaaaacacagaaggggcaaatcgcacaccatttgtgtgaattccccagggagtagcaaggcctgagaggggaaggagaggagctcattagcactctgaaaccacagagatgtcagggacagagggctgaatagacaggcctttaactaagccagttcctggcaagaagagacagctgacccctttaaggagagtgagggactcacttgttatttcagctcaacctcagatagatttgccaggtggacctgaatgtagggtgactgccattaagcatatcatctgggttagggaaaaaaggggcattctgggcagagcaggcccagatgcttgttgggtaaaccttaagtcttctttcaatgcccctcagccccttactgatcagttcatttgtcaaagtgccccctccagcctcagcagtaagtggtccagtgaaggagagcaggcaggatttcacagggcctctgggtgagattccaaacctcagagcttagcttccagttcagaagccagggtgctggggagaggcaaagttctgcccgactacagagctgccgaaggaccagccccagccccaggcctcagttccctcatgtaagagatgagggtgctggcccagtggtctcataggaccatgccagcctgaacactctctgacaggggctacataaatgggtactgaacccgggcaagcccagaggcctgagcacagtcctcggccttagccagccttctgggcctttgccagaaagcttctagttacaactactggcagggaccttatgcttcagaggtctcgaaaatattcctcctgacctcagtgtccagccccagcacagatttagcttcttggatgttcatcacagtctggtttgtaatggtcaaaaattagaaacaacttcaatgtccaataataggaaaccagttacattaattagggcaaatccttgcaactgaatgccaagcaggtgctcacaatcatgttctgggaagtataatttttcaacacagaaaatggaaaaaaaaatcagatggtaagatagcatgactaatttaagggctcctcatttctctgttcacctaccccccatcttcaccccacttccaattctagtcccactatgttcttttcagcaaaggaaaattgaaaacaacttttaaaagctggttagataaatcattgggcagttacacaatttcatattaaaattggcatggtagaagaatgagggaaaagttaacatattgaaagagtgaaaacaaaataagtctctaaaatattacttaaaggatgatcccattttggtaagaaaaaagatgtagaatggacagcgtgcagagaaaaaataagactggtgagaagaaagagtgttagggttgtcatttctgggagtaacagtggggtggatttttactttatgtttttctgaattttctaaaaagttccacaatgaactgatattatttgagtaataaaaaggaaaggcacaaaaaataaaaataaaccaacaaagaaatgtttatccatggaggaacgaaagctgggggaaatgacagatattttcaaatatctgaggattagactgcaatgagattacacttgttctgggtgacttcaaagggcagggctgaggcccatggctggaagctacatggagacacattttggctcaatcaaaggaaaactttctaacagctcagtcaccacctaacccaagggcctggcacggtcccggccctcaataaacagaggtttattatatgaggtgaaatgagttcagtgaaatgtgctgccttggacttgagagagctctctgtccctgaattttctaagtgcaagatagatcccaggtcctgaagagggaaatcttgtggggaaagagagggttgctggggagccagagcatctatcagtctctgagagttcttgctaaatttaccttcatgagctaagcgtttccttgtactgactgcatcactggctgaaaggaggagtgtggctcagagagggagccaggctgaaaagactgggctggaaggagatggtgtgcaaaggaggaagaagcacaacacctgttgtcacactcaaggatcttttccacctgtaagtggcctccgagaatcagcagaaggaaggagggagagggctaagaggcagatattcctcctgagctcggggctcatgcctgaccagactcaaccatgccacccatcatgccacctcccaccttgaacttgtgttccttcagtcaccaccttcacgttaggagctgtccagtcccttcactcccctgagcagcaggcctcagggttccacttacacccagctcccagcatgctctcctggagcccagggagccttcagacctgtttccatgggtctttgtcctccctacgcaatggctctgtcttgctacctcctaggaattgcctcagcctcatttagcttgtgggacatgaagccgctggctcttcttgttggcttttccccggcctgtaagatttaaggcctgcaagtgttgctaggcaaaagttggctgttctccttttcacttaaaacaaaacaggagtaaactggtcagcagggcagcagaaaaggtatggatcaaccaagatggagaccttcctatcagagcaattaagatcttacctctgttcccctaacagccctatagtgcttctgggttctgccagtgattgcttttccagacctttctgagagtactggggctagcattgcctagctaacggacagacaggaaaggaaagtgccatggactctgcctcaagcttagcgaaggagacaagacccgcagagagaagacagactcgatcaatctcagttgaccccagcgcccctcagtcatccttgagcatgttcccttgtcaaggccccagctccagcctccacatttcgcttggccacattccaaacttccttcagctccttaccacgttcctgcccctcccctctctctgtacagaataacctctccttctacttccctgagaaaacagaggccttcaagcgtgaattacctcagtgccatgccccactcccccctcaaacttggcctgcctttccaacttccttcccctccagccctctcttctcaggggacaaggtgcccctctggttaaaggctaatccctttgcctgggccttggcctcatccacctccttcctgggcccttcctccagccatttgttatgcttcttgtcttcgggaaagttcagcttctctacaccagctctttctctcctgattataaaatgcctgtctctgttatcccaaaaaacaagaactccccctccactgtatgttctcttgctcccctaacttgctctttctctcttgatctctttctctccctcccttctttcctctctctattttctttccctcactctcaaatttgttgaaagtagtctacatgctagacttccgcttttcctggctcccattcacacctcaaccaagagcagcttggctccagccacattatctcagtgaaagggctctgccaaaggtcaccaatgacctcctaattgccaaatttgatcacttctttgaactctgggtggcaaaagacactattggccaagtcctcatttccgaaactctcccctcttttggcctccatgatcacgctttcttggttttcctcctgcctctggaaccattcctcatggtctcttttgctggcctctcttcctctgcccattccttgaatcagtagttcttcaattacagtccacagaacaggctggtattatacagcaatgttttcacagcaaaatgagaaaaactttactaggaaagtttttcaataaatacattttttcaattataaaggactaggctgggtgctgtggctcacgcctgtaatcccagcactttgggaggctgaggcgggtggatcacttgaggtcaggagttcaagaccagcctggccaacatggcaaaaccccatctctactaaaaatacaaacattagccaggcgtggtggcacacacctgtaatcccagctactcaggaggctgagtcaggagaattgcttgaacccaggaggtggaggttgcagtgagccgagattgtgccactgcactccagcctggaaaacagagcgagactccgtctcaaaataataataataataataataataataataataataataataataaaggactctccttcgttctgagattatgctgttcctactttttggtagtaaaatgttctttgaaattatggcaatgatggaagttactttatttctttaatgtttctactctggcaaaataaaacattagtttatctatgtcagtcccataaatgtttattgaatgaatgaaagaatgagagttatgtttcccactgaaatttttccaatgggtatctcaaacttattccaaaactgaactgttttcttgccggacaaatctcctttgtacctaccttggaaaccagcattatattgacccagttactcaagctcaaaacttcggctgctgattttggtctttaccatttctgacttttgtctcctccatgttctccactcttccactctcccagttgtttcttaaattatggcctcatctgtcctctctcacctggatgctcaacagagcttcttcatagttttccctgtctgtgaggtagcctttccaatccattctcctcacagctgccccagagatttttctaaaacacatagccaagtatggtcttcctctccttaaaaacttccagtgtctatagaaaatgtccaaactccttcgtgtggcagttgaagtcctttgacatctgagctcagcctgctctccggtcttctgcctcagaagggcttccacacaccatccattgcagcctccctcaactctatctccatcctgcaaacacgccattcacctgtaatcttttcagggtttagggcctctggagggaaggctcagggtcattcttgggacagtgtattttttttctttcttttcttttctttttttttttttttgttgttgttttttttgtttctttttagacagggtctcaccctgtcgcccaggctagaatgcagtggcacgatcacagctcactgcagccttgacttcctaggctcaagcgatccttccacctcagcttcccaagtagctgggaccacaggtgtgtcccaacacccatggctattttttttcatactctataacaatgtttatatacaaatgcattgtgtatcaaatgaatacactgataccaaatgcatggactgggccatgctgtaaaatatatttcttactgtgggtcacagtcaaaaagtttgatagcactaaggagattagcgcagatgttattctgtgattcatttagttagtgctgctcatgtcattgtcctttgctctcaaaatggttctggtctcattgccgggtgtaacagaggtcaggagactggatactgcccaaagatttcatggaggaggaggagattgagttggactgggtttaaggaggctgagagaaggtggaaatgtaattctggcagagaaaagtggcacagaggtggataataagagtagagaacatttgttaaacatttatacgccaggcattattctaagcactctgcgtgaattaattcaagtctcacaaacaacccagtgaggaagatactattaaaagctgcattttaaagatgagactggggaacttacccagggtcacagagctaaaagtgacaagattgggatttgaactcggggagtctctgtgctcctaaccactgcccagccctatcctgccactggggagcagtggggagagtgggctgtcttgggaacagtgagagcctaggccagcgggcaacagagggaggagaacgttgaatgccaggttgaaatttccagcaacaagttctgcgctcctctccagaaaggagctcttcctctttccctctggcctctgtcttgcaagccggagcccctggggttgagggcaggaggcctaaacatccagtgagggtgcccagtggaggcccgaagtaatacagggtctgctctgaaagaggagcaaaggagaagtttctctccccaacccaggcctgcctccaaatcataaatagcaaatggtgcctggggcctctgccctcaagtccaaatgtcccaaatgtgccaactcttatatgcagtcccttgggttcctgggacgggggtcccctctggagaacagtttgttcctgggtcagctctcttcctacaccctctgctgcttggtccaccatttgagccagggctgtggcccatgtggtgcgggctctcttggcagaacctctcgcagctccccatttgctcctcatttggactgcagaagcctagaaaaacaaagctctgaggaagaaggtgggcaggagggaggtgtttggaaacgtcactcccagctgggctcctttccttctccgtcctgtccttccatccagctcctcccctggctccttgggccagccttttcatcctctcttctctgagacagccccctttcccagcctggcctgagaccttgggaagatgaagcgatgctgaattctcagtagtgcggtctttcctcttgtccttttagtcttggtgtcctgatgatcctggctaagtaagcaaacgatactagtaactagtggcagctatcttcctgggatgtggatcctgagaaactaacaaaaacaatgacaagaaaaatagctcacatctattgactgcttactgtgtgccaggcaccgtgctaagtgctttattgttttattattgactcctcacaaaaatcttatgaggtagttactattattgctgccatttaaaggtgagcagagactgggcgcagtggctcatgcctgtaatcccagcactttgggtgatctgcccgaggtgggcagatcacctgaggtcaggagttcaagaccctcccggtcaacatggtgaaacactgtctctactaacaatacaaaaattagctgggtgtggtggcttggggcacctgtaatcctggttactcgggaggctgaagcaggagaatcgcttgaaccccaggaggtagaggttgcagtaaaattagattgcaccactacactccagcctgggcagatagagtgaaactccatcaaaaaaaaaaagccataaaagtaaaggtcagcagaaaactgaggcatggagagattaagcaatttacccaggctcaagaagctattgagaggtttgtctgccactctaactcaggcccttcttgtctaatgcctgtacttttgcagtcgatcttaacgtggaaaaagcttgggcgctatagctagacttgggtgtgggggaaaaataatggttcctacttcacagagttgcagtgaagactgaaagaaatagtgcatggattttgcttaaaacctgacatgtagttagcactcagtaaatggtgactattatgattgttccttttgcccctccatcattgcatacattgtggctattcagagcacaggctttagaagcaggcctaggttggaagccttcctcaatcttttaccatgcaggtgatgttgggtaagtgaaccaatctctgagcctcaatttcctggggatgaaaacaatagtactcatctcccaggactggagtgaggatgaaatgaaatactgtatggaaactggtgttccttttctgtcccacatactttcaggtgtttttgcatactgggccagatttggcttcccagaacatagcttccatcctgctcagacacccgcaatggcagctcatgagtgatgggaataagaggcatttacatgttttccctgttccttcaagcctcacctctgactccaccctgctctcccccttacttccagcaggcttgttactacagtgtccctgcacatgaccatctccaccccccaaacccctgccaagactagaacaccactcttccccatgacacaaattctgccctcccttccaggtcctccttgaatccacactgactgcaggaagcctccaagccacgctaacatctgcgtccctctgcaggcctctcatttgagcttttcccccatgtaggggtgccagccctcttttcagtcacttttttggataagaagcaagcctttctatcgaggtgctgtggcttaatcttgtctcctcgctcccatcagcacctggcacaggactggggacatggcaggcgttcatttcatgtgaatggaatgatgttgacacaggtagttggtctgagaagactaatagatttagtctagcaagtagccttggggctctacggtagggtggcagacagctatgacaggtgcatgggccagggtgggattctctgttcatattggggccttctaagacagagcacccaagatcccaggatacgagtagttacagagggtcgctgttgacttggctgggacagctcatgaacaaggcaggtcaggagtaggaaagggcacaacaacagcagaggtcctttgggaaggaacctaggaatcctctcctcctcttcatgcccagctgtctcctctactgacaggacatttctaagcataattaaaatttcatctccactctttcccagacctcttccctccctcttccagcctcagcctagaccagcagccctaaaaatgtggtccaaagacccagggagcccctaaaattcaggaggttcagtcaaaactactttcatggggctgggcataggaagtatatatggatatataaagcacttctgcatactgaagtgcaattgtcatgaggaaaagcacttgcacaattgacttgcaagctaaactagcgaattttttatggaactctttttttttttttttttttttttcagacagagtctggctctgtcatgcaggctgaagtgcagtggtgccatcatggctcactgcagcctcgatctctcagcctcaagcgatcttcccacctcagcctcccaagtagctgggactataggcttgcgccaccatgcccagctaattgttttatttttttagcagagacacagtgtcgctatgttgcccaggctggtctcaaactcctgggctcaagcattccacctgcctcagcctcccaaagtgctggggagcactttatttttttttttacttgaatgattgacagataaattgtggttattcaaacttgggtgcttggcaagtattttgttaaaaatggacaaaatgatcctgtcacctcaaggaaaacaactgttactatttgttgtcaatgataaaagttacgctttcaagtaaaaagcacaattttggaaaacctgtatcagccactgtgagcttgagagcttctcaatatcctaaagagctttctaataagattagtagggatactaatgaatgtgattttttaatattgtagaatcaaaaagcgagtcagcaatgggaagatctgcataagtgggtggaccgatattttccagatgactaatgcatgatgttacaaaatcatgcatggataacagatccattcaaagtgcaattgattttttttttttgagacagaatctcactctgttgcccagactggagcacagtggcacaatcttggctcactgcaacctccacctcccaggttcaagcaatttccatgcctcaacctcccaagtagctgggactacaggcatacaccaccaagcctggctaatttttgtattttttctacagacagtgttttgccatattggccaggctggttttgaactccttacctcaagtaatccacccacctcagcctcccaaagtgctgggattacaggtgtgagccacggtgcctggctgaccagtagattttaatgtaacagagtacaaaaggttcaccgatacggtttagtttcagattcaacattgcaaagaaacattaagaaacaaccacttgtgaagtttaggtgtagttatcaagaagaatccccacaccatttattagttttgtattgctgccataacaaattaccacaaacttaacaacttagtacgatgcccatttatcatctcgcagttatataggttagaaatccaggtgtgttcacctgagttccctgcttagggtctcacaaggctgagatgaagtggttagctgagccgggctcttatctggaggctctggggaaaagtccccttccaagtttactcaggttgttagcagaatccaggtccttcagggtgtgggtctgaggcccccctgacttgctgactgtcatccagaggctgcttatggctcctagaggctacctacactccttcttacgcagctctctccatttggaaaccatcaacggcatagtcaagtttgcatctctctcacttccgacttccttttccaccactagaaaacttttttttttttttttttttttgagacagggtctcgctctgtggcccaggttggagtgcagtggtgcaatctcggcccactgcaacctccacctcccgggctcaagtgattctcctgcctcaggctcccaagcagctgggattacaggcacacaccaccacgcccggctaatttttgcatttttaataaagtgggttttgccatgttgcccagggtagtctcaaactcctgagctcaggtgattcacccacctcggcctcccaaagtgctaggattacaggtgtgagccaccgcacccggccacaaaccctcttttaaaggattcctgtgattaggtgagtacaaccttgataatttccctttgccatataactaacacaaacatgggagtgatatctcatcagaaacactcccaaaagagaagaaatttataggcatgtgagggacatttgggggtcattcttagaattctgcctaaaaggactattaaataccccccttctctacctccctatctttgtggggctggattttcttcacacacttcaaccaaaaaccacatattgcaacagctggagtgcaagagcagatatgagaatccagctgccttgtgctcagccagacattaaagagatttgcaaatattgaatataatgccactttcttgccatttttttgttttgaaaactataattgtcataaatatatattatttatgttataatgtaataggtttataatttttattttaaagtaatacataaatagttaaaatgtaagttttaattataaatatgttcaatgtcaatagatataaccctttggaggttagacaaataaaagccctttggagtcctcaataatttgttaactaatatcttttatttgtttatttttaaatttgcatagatattaaggtgctgaatgacaaaatgtggagggatgtataaaattcactcttttgggtgtgcagctccatgaattttgacaaatgcatagaattatgtaacaacaattaagagtttcaacaccccaaataatttccttatgccactccattgtagtaaaccccttccactaccccaactcctggcaaccactaatctattatccatccctaagtagtgtcatttcaagaatgtcatataaatagaacataacagtaagcagctttttgagtctggcttctttcattcagcataatacatttgagcttcacccatgtagctgtgtgtatcaatagtacattccttttgattgtgaagtagtattccattacacagatgtaccagtttattcgttcactagttgaaagacatttaggtcatttcctaaataagaatgtaaagtggtcctgagaccaaaatgttgagacccattgacagaatgtgctcttcccagagctctcctcaattgggatttttgtggaccagtggaattacaaaattttttaaaatgagggagaatcaacatatggttttcaaacttttaattttgttaattaagggcattgaaaaatactaccacctcttattttacaaaagaaaccttaataccaactattcaaagaataagtccggaattacaagtagtcttttaaattgaataagctttaaataatttacaaatcttgctacattggccttagttttctcctattggtgatcctctaccactcccttcctttcttcttaagtctgtgcattagtgcttaggaagcccttgctcaacatttctcctcctagatctgcttatccattgcctctcaaacctttattctctctttcctcccagacatgtcttcatgagcccttctcctgcctcccctcccagaacttctcttcttcacccacctttctcttacataatcattttgtctctccttcctcttctcctggacccctttcttcccagacccatctagtgtttcccttcttaccacaatctcttctcagtctgattccatcaattcaatggtgcacctactatgtattagactagaatagtgatgaaaataacaattgaaagccaaacccaatgtgcacaacaaacccccatgacatgtttacctatataacaaacctgcacatatacccctgaacctgaaataaaagttgaattaagaaaaaaaaaaaaaagccaaacccttcaggcattcacagtcctatgcaggagtagcaacaacaaatacaacccaagacaattggtggggggataacaagatgctttgggagcatagaggaggaatatccaaccaagagaccccaggaatcagggaagcaaccgttaagctgagccctaaaggataaggagttttccagacaaaaccagctgaaggtggagtagggccagggtccacaaagagttccaggcagaaggaacaggacttgtaaaggcctagagggaagggagagcattgtaggcttgagaaactgaaaggaagccagtcgggagagtggggagtgaggagagtagtacaaaaccagtttggagagctaggtaggggccaaatcatactactatgtggagaatggactgtagaaagccaaaaggagaaataggaaaatcagaagggtattgcatcccggtgagagatgatgctaaggggagtggaagtcgaaaccagcagatggacaaaaaagctaaattttggaggtagaatgggaaagatttacaggtctgatacaatgagggtcagagaaagtggaattaaggctaactctgaggtttctggcttaaacaattggctttctcaaagggagaagactgaaggaggactgatttcagttcaaagggaaatcaaggatacaattttgaggctgggcatagtggctcacacctgtaatcccagcgctttgaggggctgaagcaggaggctggcttgagcctaggagtttgagactaacctgtgcaatatagtgagaccccatctctacaaaaaaattataaaaattagctgggcgtggcggcacatgcttgtagtctcagctacttggaaggctaaggcaggaggatcccttcagtccaggagttcaaggttattgtgagctgtgatcatgccacttgcattccagtccaggcaacagagcaagaccctggacatgttgcatttgagacaactttcagctatccaaatggagatgccagtatataaaggtctgaagcccagagaagtctgggctgaaaatgatgatttggaagtcgtcagatgatagaggataactgaaaccacagaggataaatgagacttcccagaatgggaatgcagagtgaggaacgaggacttaggtcaggctcctgagaagtgcccatatttaagggtctggcagaggcagaggtaccaatgaagaagtacccagaaagataagagggaaaccagaggagtgttgttatcacagaggccaagaggagaaagtatttcaaggaagacaaggttatcaagggcattgaatgttgcatagaggtcatggaaattaaggactaaaaagtggccattggatttggtgacatgcggtcattggtaactgtgacaagaacttcttttggtggaacagtgagggtgaaatgtctctaagtctctctctgccctagaccctaactccttctcccagagtccatccctacaccctcttccttagagtctcttacttctccttctagactcctcttttcatagcatcatttcctccctgcccttcaagaccttgctttctacagagctctctttgattttcttcctcaaagaccctttttctctcttctccttttctcttcccccaaaccacctcttcccatactcttatttccctccctttattctctccctactcacttgtctcctgaactaaatgctgcttttctcagactgctattctttcctgttctttcagccccctctccattcccgcacccatctaagctctttggatctcagcaggggtcttggcagaaggattactaaagaacctcctaggctcaacactgaggagtcatagtatttggcatgattccaccaggatctgacaatgccgacctgaaggaaacacagtgttagaacccagtccttgaatgattgccaatctggaaaccacatcctgccaacacagtctcctcatccgccctggcacctgcccctaagattctgccttttcctatcctcaattgcacagtcactatgaactgataaggtgcccctctactacattctgcattcaatcagcattttctacttgtcaaaatgcattcacattcattcacccagccttgggaattcggctgggtgaagcctgggaaaagaaaatggagaggcttgcctgaggtcacatagttggttagaggattagcctggtatccctcccaccccttcagccttgcttgctttcatgcccaaagactccccaggcctgagctcaggcatggctgcccttttagcgtgtcccagcctgccaagagggagtgccctggagagacccttgctcaggagcactgccaggggatcagtgccccatttgtacctgcaaggtagggatgggccgccttgggaaggaggatgatttctggtttgcttcactgagttcaccctaggcaacaaatccgactgtttgctttgatatgacttgaaaaatagagtcaagcataatgactatgaggcaagctctagaggtggccaggtttggtacccaggccttgctctgtactagcacagtgagaccatggataggaaacacctcagcacagtgcctggcacctagcaagtgttcaatgaaccgtggccttatcatttgtacatgggaatccttgggagggagttggtgttgtacactgcaaagtttgccaagctagatatctacagacctagattccaagtctaactattactgctcaacttgggatgttgggcaactcttttcatctcattgggccgaggtttcctcatctggaaatagtaatggctgtcttatttttgtaacatgttgtattggcctttaaaacatgcacactctttcacctagcaattctattcttaagactttgtcagtattatgtgcaaagatgctgggttatagtgaaaatgaaaataacaaaacgtctagtagtttacgattaaataaatcatattttatatgatagaatgcagtgcagccatgacagaatgatgtagttctgtgttttaattgacatggaaataggtccacgatatgttatttacaaatgatgtaaggttacataaactgtaggtatagtgtgattcaattttataaaacaaatcccatcgatatcttctacaatacatcaaaatgttagcaatgattatttctggctggtggcattatgaggacctctattttcttctttataattcattttctgaattcttttcaatagcatctagtatttttctacttagaaaaaactagaaagcttttttgcgttgggagagtaaagccagtcactgcgctctactactccacagcatgtttttttgtttgtttgttttggtttggttttatttctgttgttgtttgggtttttgtttgtttgctttgcttttttgagatggagtctcactctgtcacccaggctggagtgcagtggtatgatctcggctcattgcaacctccgcctcctgggtccaagtgattctcctgcctcagcttcccgtgtagctgggactacaggtgcgcaccaccacatccagctaatttttgtatttttagtagagacaaggtttaaccgcgttggccaggctgttttcgaactcctgacctcaggtgatccacccgcctcggcctcccaaagtgctgggattacaggcgtgagccactgcacacggccttcacagcacttttgagaggcttaaatgacatagtgcatggcactgccatgtgtggtaaaaaggagagccctgtccttatgctggcctactcagttccaccttgtaggacctgctctttgaactcagagtctgaacctacagtacccatgtttgcccttgagccttgggaccaaccttaggggtggggtagggctgagggcctgccagagaatcaagctgagtagaaaagtctatggagctgcaggccatgcagggctgcttgggcactggctcaccagggctgtgtttatgcagcttactccctgctgggcttcagggctgctagccagggacacctaattggtgggacagagccccctcctctcaccaccctcaaagctggaatgttctgaattccttcttgggccaaatccccctccccacaaggcctctcctgggttcacagaggtcaccacacaaaagcccagctggagtggagtttttgacagaaaaaaaaaaacacacacagaaaacccaccaaacctttttttttttttttctaaagtgcctcaatctttcccagcctccaggggtttaattctgatctgtaataagtctctgacccacggctcagatttgcagatggattttgcaaagctgtggttaacgattagaaatcctttatcacctcagcccgtggccccttgtacttcgctcccctccctcaggatccctttctccctctccaggggcatctccccctccaaggctctgcaaagaactgccctgtaagtatctccatcctgatatagttgctgccttttaaattcaccgaggtgggcactcttccttcctagtcactatccattcaccccatggtggagccaggctgggccaccttgggtttctgagtgaagggtatgggaggggaaactccggtggcatttgggttggtggtatttgttccctcaaagctatcacaaaggttcaaatctttaaaacttcaggaccagagaaagcactctccaaatcagatattttctggtttgggggcttaaaaggactgggataaaaattggaggaagggagccacagtttacccctctgcctaagtgtaggggactgaggagtggcagaaggggcactccctcacagccagctccagtgccctccttggcatgaaggctcagggaggtagcagaaggtgggttcctaagtgaagtcataaagtttccccatgaggtccttcaaggactctccctcactggtctgcaagtctgtcattagaaattccttctttcgactgaggtattactctcttcaagtgccctctttgaaaatgcagttggaaccaaaacattcacagcacttatggccggggagatcgtaggcgatttttgttttctaaattctgcctttctgtgttttccagtgttctaaagtgagaatgctttactttgatgatcaggacaaaaatcaacttctttttcaaacaataagaaaatctctcaatccagttgcaattctctgaactgccatcaatcaattgatgtagaaggaaagatgaactgctctaaggacaaactttcaagaaagtagggcctcaagggaatggctttgccacctactagtgcccttggcagctggaagtgagtttcagagaagggggcaagtgtctcagattcttatgaggggcagtgagatcaagggatatagaaatgaggctgactgacagaagagggctgtggtggccatcatcacccccagaaggccacatcagttccttccttgagcctgggaaccccaagtgccctgtcccatgtagtcttaggagggtactgccaaagaaagagtaccatgcacaagactcttggagcaagagatggggagaatagcagggaaagtacctaggtgagaaggggttaagtcaggagctgcggtcaatcttgaccctcctaatcctctcctgcagctccaatctccccactagggaagattaagtaaggatcctaagttaaactttcttgcccagtccttgggccatggagtatgttggccctatgcccagaagacaaattcagctgacaaggcctagagtcctctgtacctccaacgcagccagtacttgacttctaggaggatccctcaaagagaggcttctattaaaactggctgcttctaataacagctcttcagtcttctatatttgtcaaagtggcttcctgtccccatgcctttatttgagactaaaaatcttggagatgacaaactagggcctagagaagctataggacttcctcagcaggttctaggcagaactgacacaacaagaagctagatcttttgattctaacaccaggaccctgtctgccctcacctctactgctcatcagacaaacaaaaacctggctgaatccagcctgtctcaccacccaaccattcgccatttagctggtcttcctaactctggtggaaagctgaaccccccctccatggggccatttctatcacttgaataagctccaataacttgttcttcctcctgcctgggcatgctgctatgccaagtcagactctagagattccaagcctcagtaatggcattttcttgactctgccctctccctcaccccaaaacacttgcctacttactactacttaggacaggctctggggagaggctttcctcttggggacactgttgattcccttgggaaactcaagcttgactcttcagctgccatcccaggaaggctgaagcaggagctgctcctctgggaagcagtaggtcttccccttgaaaacctcaaggtatctcaccaattctcactgaaagctcagatacaaataggaggaagaaaggaaaagtattgaacccagcctgggtgaggagcagggagggcccaaggatggtttcaaggcaaggatgcatcctcaaagatgatttgcaattatccaagcaaatggtggatggtagaatagcatgcttacgggcttggagacagagagaaaggcagtcagagaaattcaagtgcttaggtttggctggatcatatgtgtatgtataggagcataaagcatgaggttggaggttaatggtgtgagatgaggctgtgaagaaaagccggggtgaaataatggagggctttcttggtttcctgggctagcaagtttgaacttcatcctgaaatacttaagagctctgaagatttttttttttttttttttttgagacaaagttttgctctatcgctcaggctggagtgcagtggcacaatctcggctcactgcaacctccacctcccggttccagcgattctcctgcctcagcctccctagtagctgggattacaggcacatgccaccacgcccaactaatttttgtatttttcgtagagacggggtttcactatgttggccaggctggtctcaaactcctgacctcgtgatctgcccgcctcggcctcccaaagtgctgggattataggcgtaagccaccgcacccggctgagctcctgaagatttttaagcatggcaaagcgtgaggtgaaagtcacaatttgatttcaactttacaaagatctttgactactgggtaggtaattcattattgcaggattggggcagaagtggaattagagagatcaatttgaggtgtctatgagattttcaaatagacaagaaacgatggttgcatagtctgaactatggtttagggcagtggcgacagaaagaagtagatggattcacagtctatttttgaaggcagacctgatggtacattataattaattatatgtcaacaagaggtgaaaaagcaaggatgactggcttgggttattaactcagtgacagccccactgaggtaaggaacactgcatgaggagcagtttgggcatggggagcaaaaagggcagatgattccagctttgcaaatgttgaatttgaggccattaaaacattcaggtagggccattccaagtaatagttaactacacaaatcttgagttcaggagagaaatctgtggcagagatatgaattcaggagtcactggcatggagacagagaggatgagataacccatgaagaatgtgaaggataagaagagccatctagaagtcgagatgaaaccctgaggaggctagaggggcagagatggatagttagacttaaagagtgagcagaagaagaggaacttataagggaaaactagaagaatcattttgagaagtagttaaaatggagtggtgttacagaaaacaagggagaagatagttttatgaaggagagagacaaggtgagatgacagagatatgatcattgaattttggatcaagaaaagagttgataactttggtgagaatattttcagtggagggctaatggtggaagccagactgcagagggctgagcagtgagtgggagggtgaagaagtggagacatcaataatgaatggcttgtttaaggatcttggctgcaaagagaatgatcaagataggagtaatagctgcacagggaggaggtagagtagggagctcaaaaagtagtagtaaatgtttgaagcagtcatcagaagggtgcttaccagggagaagtagaaggatttccaagcagcactgaaggcctcaatgagatacatagtcatgatcaggacaggtacaattgtgccaaggttagcaataagaaaccaatgtcaagaaagacttgctaatgagtgacagaggtgagattcaaactatgtttctctcccttcatcaaatgtttatcggctcctgctctgcactgctttgcatcaacactggcattggtgtttccaatgctgatgaatcgtattgactatcaatcatgtgcccaatgctgtggaagcatgatagacatttaatatatattttttcacccttaaattgtttagaatttggttgaggagacaaaatattccacaaatgcatatatattataaatatatataatatacattatatatatacatagtgaagctctgctgtctctctctccccccttacctctttcttcctctgatcccccatctctctctttcttctttcccaacgttgggcagcacttcaatgacccttacactgaagcgttattgactcatttggaaagtccctatattttagtcatatggagcccctcaaacctctttgccaacttcattcatttattaagaagacagtttttgaattgctgctctggataaagcagtatgtaaggcacatgagatacagagatacataagatatagtcttgccctcaagtagctcacaggctaatagggaagaatgagggtttaaacaggaaattgcaacataatgcaaaatgtactatctctgcctcagtttcttcatctatacaatagggattattagtgcctaccacaaaaaaacctgtgacgactaaataagttagcatgtaaaaagtgcttataatggtcccataagaaacactacataagtgttgctattattattattactatgatggaagtaaacacaagatactgtaagaatagacaggaggggtacttgacccaggctagagtaagagacatctgtgctgaatcctaaaagatgagaaggcactaaacagaggaagaagaatacataacactctgcatagaatattctgttctatttctatttgggagcaaaagaccacatggcatgattgaagaactggaagtaatttaattccacaatagtacagactatgaggagggaaatggcaagagatgaagcttgagaggtcatggggtaaaccaagcaagtttggactttactttttagcaaatggggagccactggaatgctttatgtagagtagtgactcgatcagattaatgtgttgaaagatcaccttggcaatgatgtggagaatgaattgggagaaagacaagttagaaagctgttgctataatccaggtgaaagagaatgatgaggtcgtgcatggtggctcacacctgtaatcccagcattttgggaggctgaggtgggcggatcacttgcagtcaggagttggagatcagcctggccagcatggcaaaaccctgtctctactaaaaatacaaaattagctgggcgtggtggcgtgcacctgtagtcccagctactcaggaagctgaggcacaagaatcacttgaacctgggaggtggagattgcagtgagctaagatcacgccaccccactccaggctgggcaacaaaagcaaaattcggtctcaaaaaaagaatggtgaaactgaactagggaagtagcagtggaaatggagagaaaggaaccatggatttgaggtatattcataaggtagaactggtgggacatagggactataggatgcaggaggtaagtagaagaaaggtgctaaagatcactttccggattttggtctggcacaagtggatggatagaggtatcattcagtgaacacagggaacacagggaagaactgtttggggaaagctgcatgggggatgtgatgagttcacttttggacatgtcaaattcgagatgtctatgagatttccctgtggagattctgactaggtgattgctctgccagtcttgaagctcagaagggtctatcctggaaattcagatttgggagggtcagtggatgggtagtagattaagttatgggggcaagatgagtttgctcagggacagagtgttaattgagaaaaggatggacttctgaggaatactcacatttaagagatgagtagggaaagagaaatcttgaagaaggctaaaatggaatagccagattgtggtgggttgaaaaattagtgggttagttcgggcacggtggctcatgcctgtaatcctagcactttgggaggctgaggcaggtggatcacttgagcttaggagttcaagaccagtgtgggcaacatggcaaaacctggtctctacaaaaaatacacacacacacacacaactagccaggtgtggtgatgcgctcctgtagtcccagctacttgtggggctgaggcaggaggatcacacacacacacacacacacacacacacacacacacacaactagccaggtgtggtgatgcgctcctgtagtcccagctacttgtggggctgaggcaggaggatcacacacacacacacacacacacacacacacacacacacaaactagccaggtgtggtgatgcgctcctgtagtcccagctacttgtggggctgaggcaggaggatcacttgagcccaggaggtcgaggctgcaatgagccgagatcatgccactgcactccagcctgggtgccaaagtgagaacctgtctcaaaaagaaagaaagaaaaattagtggatcagagggtcttgtagagaatggggaggtgtgcccttgacccttagtgtcctgaatcttggcaacaccgagggctccttgaacacggcaaaatcttatatggctctgagattccaaagcattgactcagatacctgcctcatgcaaagccctatattctagagcagtttccctttcctctgtggcagactcttgtcccccctaacagatggcccagggaatttcagggccccctctcagtcctggaacccttgttccagagtgctccctcatcatccaagaggctgatgatgggagcatctattaggagactggacaggaaatgtctgggcatgttatacatgcaggaggccttagactaggctgcagagggggatttgggcatggctgggaggatctgaactctcagagtatggacagaaggctttgctgcccacccccatctaccctggagtagattttcaccatgggcagaatgatccagggctaggccactactctctaggcccctggagattcaagaggcctctaacaaactggagtccaagactacattctaggatctgttcctcctgatgtagtctgcagtttggcctcagtctgcaattgaggggccctatggcactgttgcttggcaatgtattaaacagcaggccttggagactagcacttgagttaacacagccaccacaaccaccactgccatcatcaccttcccggaaagcagccacctgtctggctcctggctttgtccagctgccaacctaaggcatgtgcctacgcaggaggcgatgacattttggctccacgttcaaagttgttttttttttcctttctcatgtgttatttctaaagataacaaaggtcaaaaggcatccagcgttttctggtttctcataagcttctggtcaatatttaatctggtttatggattttttttaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattg

SEQ ID NO: 4853 - DNA, 179467 bp, human
atctgccaggacggtctttatagatgttgaggaggtcaagaataaatcttgtttgacctttaccgatgatggatgtgggatgacacctcataaactacaccgaatgctcaggtaaaaatgtcttcattgtctttttcttgtcttaagctcatgaaccctatttaaggcttcataattttcattaatattttgctttccttttgttcattcaacaaatatttattaagcatctcttatgtgccagggcactggttatgaaacaaatactgttccttccctcacagagctttcagcctagctggcaactcagacaaattaaataagtaataaaaagctataagcataataagaaggtacagaatgtttgagacaagtcatcaggggagcccaatctgatcccagaggttaggaaaagtatcctagacaaaatgatatttaagctgagatctaagggtgagtacagtttaaccagctaaataaaggggcagggagcaagggatgacaattcacacaaagagaacagcaaatataaagacccagaggccttcactggtccgagacctccaatttatattaacctaaactcactcttaaatcagaagtattggagttggggtgatttattgattagaaccacgaaggtacctgggtataatcaaaccccatgcaaggtaaatagaaggcattcagacatatattctttaaaggttttgcagtagaatcacaaacttaggaaattctcctttctaactgttaaagcttgtgctagatttctattgccactgtcagttcatttaatcactttaaaacatttgtagttgagaacgtaaatttatactatatcatctccgcatatcactcagtggaatatgagtattccttcaactccttccttctctcttccttttagcagatgaggttgattactctccctgtggcttcctgaactagagtgtgtgaagcacgagtaacaatggtggaatgctgtggaggagggaaagggctccaaactataaaaatggaaaacaaattcatgtggttgtagttacccttgtaggtattctaaatcaattactctgtttgtagggaaatccctttgattcatcaaagaaacaaaaatgaaatttgggcaaagtaaatggttgcgttttaccactcagcagtctgtataccttgtgtctcagaccctcctaattagaagactatttgaggaaaacctctaaaagtgaaacaagaattgtgaccagtatgttagtgaaggtagaaagttggcccaatcctttaacttataacatcagttttatatcctgaagttaatattatatattaagaaaaatacaattttagatgggatggaaccaaagcatttatatgttcaattctgtatgtactagttggttgttttccccgtaaaattacttgtcttcttattttttgagacagagtctcactccatcacccaggctggagtgcagtggcatgatctcagctcactgcaacctcagcctcctggtttcaaatgattctcgtacctcagcctcccgagtagctgggattataggggtgtgccaccatgcccggctaatttttttgtatttttagtagagacagggttttgccatgttgtccaggctggtctcgaactcctgacctcaagtgatctgcccacctcagcctcccaaagtgctgggatcacaggtgtgaaccaccgcacccatccaaaattgcttatcttcttaatgactccttcccatcataccttatcccattgacgtgggtgttgagtagtgggcccagcacatctgatcttccgttttgtctgtgggactacatctgtgaaacttggttagagttataaggtagaagggaggagaagaatggtttcaaaataattgccacaatttttgttccagattcattcatttattcattcaacaaatttttattgagcacctgtgtgcaaggcactggagataaagtggtgaaccagatagacatgattcttggctgacagcttaatgagaaagaacaaaattgactagtaatataactaaataggctattccacccagtggtaagtgctatgaaggtagagcacagtttctttgagaacgtataacagggatctaatctagtctagggaattaaaaaaggctcccctgaagaaatgacattcaaattgaaatatgaaggatgagtatcacccattcaaattttttattccctccccaaggagcaaaataggtagaaactttcttagctatagaattttccctatcataccaaatatgtttaccactgatttgagctgggcaattgttcctcctatttaaaaaataattttagaaaattattttaatgagtccttaatgtaatatatgtactgaattttatttgtgattgtatcttgaaacaaacttgaatcagctagaagatacctttttttttaattaaaaaaaaatttttttgagatggagtttcactcttgtccctcaggctggagtgcaatggcatgatctcagctcattgcaacctgcccctcctgggttcacgcaactctcctgcctcagcctcccaagtagctgggattacaggcaggtacaatcacgcccagctaatttttgtatttttagtagagacggggtttcaccatgttggccaggctggtcttgaactcctgacccgaagtgatcagcccgccttggcctcccaaagtgctgagattacaggcatgagccaccgtgcccggtgaagataccatttatttaaaagagatcatttaaggccaagcatggtggctcatgcctataattctagcacttccaaaggccaaggcaggcagattgcctgagtccaggagtttgatgcctgcctgggcaacacagggggaccccatccttacaaaaaaatacaaaaattagctgaacattttggcatgcacctgtagtccctgctactcgggaggctgaagtgggaggattgcttgaacccaggaagcggaggttgcagtgagctgagattgtgccattgtaatccagcttgggcaacagagggagaccttgtctcaaaaataaataaataaataaataaaaataaaagagattttttagtccaatcctaacttccagcaaaggattctatttttttttttattagatggagttttgctctgtcgccaggctggagtgcagtggcgcgatctcggctcactgcaacctccgcctcctgggttcaagcaattttcctgcctcagcctcccgagtagctgggactacaggtgtgcgccaccatacccagctaatttttgtagttttagtagagacggggttttaccatgttggcagccaggatggtctccatcccttgaccttgtgattcacctgcctcgggctcccaaaatgctgggattacaggcatgagccaccacgcctggcccgaaggattctatgttttctgggttttttttttttttttggatggagtttcactcttgttgcccaggctggagtgcaatggtgtgatcttggctcactgcaacctccgcctcccggattcaagtgattctcctacctcagcctcccgagtagctgggattacaggcatgcgccaccatgcctggctaattttgtatttttagtagagacggggtttcaccatgttggtcagctggtcttgaactccctaactgaagtgatccgcctgcctcggcctcccaaagtgctgggattacaggcatgagccaccgtgcctggtgctgttttctacttgaaggcatattacttttgtatttggaaaaaataatagaagtaattatacaaatttattaagcctacagaagttctatttgacctctaacatttgttgttacactgtccacactttccaactctttatgcaactctattttcaggctgataaaatagttgtgtaactgtagcaacagtttcttccataaacatagactttcatgaaaatcaaattaaaaaggaaaaacctattattaaattcctttaaggtccacaactaattatctttagcttctggggctagtgtgtggatcagttagtctgtatattcagctgcctttttcagcaaggtggaaaacctctttcaaagttcaaagactaaaaacagccacagaaccacagaaggtatttgctacctgtgctcagaagtgcacttcctagcaggtgtattcttctaaaacaatagctggagaataacagtctgcttagcactctttcattcttttatattacatattaaatcacaagtatacctaggaaatagcagtgcctgcctttgtgcacccatggattttgccaaggtttgtttcattggtcagagtctttacttatttattatttttcttaacttttatttttggtttggaggtacacgtgaaggtttgttacataggtaaacacgtgtcatggcagagtcccaatttaaatttacctctctggattctggattcttgacattttaagatactccagagcaagctgctgtatttttggattccactaaaagtgctggtatccaagccaccttgatgtgtaaacagtgttgtctctcacacgagaggatagagcaggactgacttagcaaatagaaaccacctaaaccaagttatctctgtggaaaattattactgagctatagcaaactatcaaattcattattacaattctattattatgtgtggtgagggcttttgtgttaggtagttatttgattggtacctgacattgattctgccagtttgcatttaaatagaatgccgaacatgagaacttaggtggaataaaagagcacacgggaagagttaagtgaaacacagtaacaacaacaaaaatccagagtttatagctcctctcttctcgttattcttatccttttccattctggttctggcctggcactactacttatcttctcaaccttgtatcataatttggtctcctcaaattaacacagtgagggtttatactttcaaaggggaaaagaggtgatagatggtggaagaggctaaaaaattaagggagttgtaatctccctattttcaccactttcccttgatcacctaattgaagcttttgtggtataagagaaagttgaagtccggttaacgatacaaattcatttgaagtgatgtgtaagattactatttatgaagagccctgagctttagatgtgaccttaggtctgaagtaggagtaggggatagcacatgacaactatcagaatgacttctagagttagtttaaaattaatgtttgaatactactttatacttaatgtattttgcatacagtatataatttaatcctcataacaaacccattttttttaaaagccaattcttccacaagaaaaatgggaatgcctgaatcttactattataagtctgtatcctggaatactaaggcccataggcaacacaaactgaagttctttttctttttttttttcccaaaggactgctgccatggaaattacctttttctgtcactagatttatttgtaggatacacacagctcctataaagtatctactctaggaggacatatggtattattgtataatgctttgaaacagaaaattaaaaggtggttccctttcttagtgagtaaacacaaaaccgcaatcttcaggaagtagaaatcagatacctccgctctccatgctcaaaagagtaaaattgttaaagatcagcctgctcagtcatggtctgaccagagtatctattttattgatgttgagaagcacctaatctgtaatatatgaagtccttccttagactataaactctgaaggcaagaatcatgtctcttattaaaaatggtctctagtgcttagcccaatgcttggcacattgtaggtgcttagtttaaatatttattgaatgaatgatagtgcacaacattgtaaaattagtcaatctggagagaaacaatcctttttagtatgattttttcttttattgatacctaatattttacatatttatggggtacatgtgagtactttatacatgcatacaatgtgtaatgatcaagtgagggtgtttggggtttccatcaccttgataatttatatgttggtaacattggaactcctcttttctagctactttgaaatatgtgatgtattattgctaattatagtcaccctggtctgctatggaacattagaacttttttcttctatctaactataagtttgtactcatttgccaaactctattcatttctccttctcatcctgagaaacaatccttacaattagttttattgatggtgagggaagatatataatcattttatttttaatttttaaagttctgttattttggtgtgtacctgaatggaaaatacaaggaagggaaaggttctggcttccagattaagctgatcaaaaggggctacagagattgttgaggcgcctaagtgaaaggtccttaatggagcaagagagactttatactgcaactgtttgctgatattcagaggcagaactacctatttttatcctttggccacattccaatgaactgtcccagcagatggaacagagactaagaattggaagggttatcctttgagtggagagttgaaattgtcaagatacatgatccctgactttcagatttctagaggatgatataaacaggttaggagatgcctaatctagtacctctgaccaatgacaatatctggaacttttgctaccctctctagataactacatttttcaccttaccctaactttacttctacagcaatcagagctgttttatctagacaagaaaggcagctgcccaaggccttctccagctacgttagctggtgaaaaggggcccttttttacatttataaagtgtgactctaacgtaatggaactatttatgtatacacaaaccacacaggaaaattagtcccattaccccatagtaatttcctatgtttttaacttaatagttttgcccataaataccaaaaggaataaaaaaggaaggactttttacaagtgttatttatttgtaggccaaatattctgcctgtcacctatcttaggatgctttttacctttctgatttctttttttctgatttgttttttcttgtgtaattgcagctttggctttacagataaagtaataaagaagagccagtgtcccattggggtctttggtaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattcaaccagcaaaacaatatcctttctggaaatggagaatgttggttaaaaattagtctaatctgagtgtttgattagattccaacttcaggtcaaatccaactgtcagaagttttaaaagaggtattcaaatgtcttaaatttaactgggatttttctctattaaacatttaaaaaacaagtagaacattgacataagcttagaaatgtttttgctatattgaaattttcattgttaggcagtttgatctatatagtgtatctctgctctaccaccaccccatggtaaagctccgaaggccttcctttttttttttttcccctaaggatagctacatttgcattaataggcctagaaacatactatttatcagcttatataatagcagaatagctcatttccctatatctgcacagctgttacttctgttagacacctggttctcttgactggaacagtatagcaataaggttttaacttattgcttccaaagaagttaaaaaattaagcctttgatcttttaaatataagactttgtttacatgatatctttgaagctatattctgcatgggcaactgattttggagcttgtctctacaacctttctccatttttcacctttcctccttctatagcagtaatatgcatgctgtatgtctatagttttgtctaaatatgcaatccaaagggcagatcttccttctcaatagcatcctaagatattattttttctttgactatatttgattttacaaaaaatgattattaccgaggattcattgcccagcctagaagccatcttgaactattccattttcaaccgtgaaaatgacctgctggcccagtttgatgccatcccaggcaaaaaaggcactcgtgttctcatttggaacatccgcaggtatagtattccaagggtgatagattctaataaacaaaggtagtatgatgaaacacatttttatttaattttaacttttaaaatttttataaaaagacagggtctcattatgttgcccaggctggtctcgaacacctggcttcaagtgatattccctccttagcctcccaaattattgggattacaagtgtgagccactgtgcttggcctagcaccttttaataactctttttagagtaatttagagcaaagtagataaattttaatatatatctcattgcatacttttatgtaactttgtcttagaaaaacaagagttctggccgggtgcggtggctcatgcttgtaattccagcactttgggaggccgaggtgggcagatcatgaggttgagagatcgagacctctcacctggccaacatggtgaaaccccgtctctattaaaaaaaaaatacaaaaattagctgggcatggtggtgtgtgcctgtagtcccagctacttgggaggctgaggcaggagaatcgcttgaacccaggaggtggaggttgcagtgagcagagatcgcgcctctgcactccagcctggtgacagagtgagactctgtctcaaaaaaaaaaaaaaaaaaaaaagaaaaaagaaaaacagagttgtttgagttagtggtttttgttggtaaaatgtggcatgtttaaggtggaaacacacatatcctgaggctattgccacagataattaagacagtttagcatattctaagctcctcagaatcctttataaatatctatttcatattcatggacattttttttttttgagacagagtctctcttgcccaggctggagtgcagtggtgcaaacttggttcactgtaaccttcacctcctgggttcaagtgattctcatgcctcagcctctcgagtagctgggattacaggtgtgcgccaccatgtctggctaatttttatatttttttctagagacggggttttgccatgttggccgggctgatcttgtactcctgacctcaagtgatccacccaccccagcctctattactggcatgagccaccgtgcctggccaataggcatttttttaagtttggtaattgatagttattttacctattagacaatgacaatgaagtatgagaaaaaaaattagagtaaacaaagcacaataagatctttaaaaaataaggagttctgtgttagtgctttcacagtagctgggttagaagtagaaaaatctggccaggtgtggtggctcacacctgtaattccagtactttgggaggccaaggcaggaggatcacttgaggccaggaatttgagaccagcctgggcaacaaaatgagaccctgtctctttaaaaaaaaaaaaaagaagtagaaaaaatctttgaagcagataaatatgaactataatgagactaggttaagatcatgtcttcaaaactaataaaaatctagaaatactttatgctatttcatttgtttaatcttagcatgtctaatggaatacatttaagaatggattaacacctaaacactaaaaaataaccctaaaaacctttaatataaaatagaggtattactgatatgtttaatagaaaagattatcggataaatgtattcttccttttctccttaggtgaagtattttgtctcatttacctgggtaaaacaaataaaaacaatgctagtttatatagagagtactgtacttaacaattaaaagaagtgtgactcacacattggtaatttagatcttccctgtgtcctactgagaaaacctcaagtaatatagtttgtattacaaagaattttttgaggtatttccagtgatttacatatcttaaacagaactttttctttgtatgtcgtttcccagttatgtatatggtactaggtggtatacaggttgactttccctaatccaaaaatctaaaatcggaagtgctacaaaatccaaaacattttgagcacagacatgacaactcaaaggaaatgatcattggagcattttggattttggatttttggattaggggtgctcaaccagtaagtataatgcaaatatttcaaaatccaaaaggatccaaaacacttctggtcccaagcatttcagttaagggatattcaacctgtataaataaaggattacatggtcaaacaaatttgggaaaagctgacttaaagtttactgtgttgctttattgtaggacttctgagagtcctggagtcctttaatatactaatgtgcgttgaaaatatgtaaaagagcaatatagtatgaagtatttcccaatcaatttttaaaaagtatttcttcaggttgggtggtggctcacacctctaatcccagccctttgggaggctgagatgggagaatcgcttgagcccagaagttggaggcgacagtgagctatgatcatgccactgcactctagcctgggcagcagagaaagaccctgtctctaagaaaatgtttctacagaccttttttccttagatggggaatgtgagggacaaggaggatagagaatctcctcagggcatatgcattggggtcaggtggggtagtgagaatcagaattatcctggaaaatccataataagctattatacattgacatgggcatgatgcagacaacagaccataatggctctggtgcagccctgtaaaaggagctacaatttcaacacagcagctctgagcttatagagcctgaagtatgaagcagagttatcactagagctcgagttgactctgagggctaagaatgatttctcaattttatttgatcatagaacttttatgtatttatttctttttaagagtatcttgtgagattactgttccacagaacaaattttgggaagtactgttctgatatatacatttttactaaaacctgtcatttgagttttttccaagaataaagatgggtcttaacgttttttccctggcagtggttagtgatatagctcagggtcttggaatggatcaaaaccaagtggcccaaaaagattatgggaacaagaaaggtccttatgaaaggaatgttagtaccattatgtttaaatgataattctataaatggtatcctagaggactagttaaatatatgctgcttttgtaacaatcttttttccttttaagaaataagattagatctggggagatcttagtgtcttattagtctgaagttggtagaagtgggttttgattcatctgtttattcagttggggaaaatgatgttgagtgacttactaacaatacccagaaagcttgtgtctatttcaagatcccactttgaggatagctgacatccatttgatttatcagatcatagacattccacattcttttttccttatgaatgtggcatcatcacctctatgaaagagtagatttgtttagaatgggaatacccttaagtattgtctgatcctctacccaagtagtttgtagttcctttgcactggtagtcagggaaagaaacagatacctgagttttggctcatattgtttttttttcttttgggctcctagtgcatttttttgtcctctggagccagtttttgttagattggtacttgtctcttttccccagaaataaaaatggaaaatctgagttggactttgatacagatcaatatgacatcctggtatcagactttgacacagaagaaaaaatgactggcggtgttacctctgagctaccagaaacagaatattctttaagggtaagtaagaatggtttttcaacaatgagaggtaagatttcctgtaacctgaaaatattatagaacaagatcttcttttagttatacaaagataacaacgttccagccatgtgctagtattcctttttattgtctccattgagaccgtttagataatatagtcagcagtactttagtgtggtagtttacatagtgtaataaggtatagaaactgagccaaatctttgcccagcatagatatcagttggtagcagtgttttatggggatgtcagcagaattggcaatatcacataataactttcccttcaccattctgttccgtaggcattttgtggtattctatacatgaagccacgcatgaaaatttttctgcgtcaaaagaaggtgactacccagatgattgccaagagcctggccaatgtagaatatgatacatataaacctaccttcacagtatccttacaagtgtaccactacatgaagttgacctctttatttcaggattaagttttcaggttgacacagaaaaacaaaaactttccctttcaaattaaaaagtgtatgtcatagtacacattctattacagtgtactctgaggaagtctttcttaaatgccaatctgtgtaccatttttatcagaaatcacctggaaactgttgaaataatagaatcttgagactttggagattctggttcagtagtgtctgaaaccttttttaaaaaaaataagaattatttatttattttaaaatcctcagctgattctaatgagcagccaggtttgagaacctctgctataaggaataatacacattatttggtttgtactggattttgatatatattaaattgattgaaattagcaaaatactgactagaacgtcttaatcttgtagatgcactgcaattttttgttggaacaggtccagacttacattgattgaaattaggagggtggaaattaaaaggtgattttctagagtgaagtaaatcttcttaggtttgacataaattcctggtacttttcataatggtagccactcagaggagccattacttgtttttacttctacctctcccttgcatagcattgagaatggatttcagaaactagaaaaaaatcttaagatgaactatggaaattaggtacaactttgttgatggcttttggggcagaaaacatctttgaaaggctgaaaacttgcaaggttatgaaaaattgtccttttaatttattttctagtaactaagcaccactcttggcccgagaaacatgtttacactctatttgctttatcaaaggcattatctagcatgctttgtctttccctgaccaaaaatgagaaatcgttggtctcttttttctcctttttgagaacacatatcttggctactaggaatgttttcttaaagcataaacaaatcaatttaataaagccagagctagcattgtttgcttctataggtgaattagttataatctcaccatatgtagactaggatgttggtgccataggtttaacagagccagtctaaagaagtgcttgccaactactgtgttaggatataacacatacctgtctctagcttttttcttttgtgggtttctatcagggaaacttctatgcatgcattctatatgttacctcgactcttctcagactcccttcccattaaaccaaattaccttccgatattatagtttggactaaacagatttactgtagacatgagtaaaatgaaagtcctaataaaatttcccccaaggtcactgaggaacaagatcattgatactaacttacttacttctcaattatcaaaggccacttctttcatctttgttctctctccttatgctaatttggtgtctcctaccccactgtaccctcactccataatttagaattttaaaagtgcacaacagaaagaaaaatttgacagtctttatctttacaaagataattttatggcataggattttggtttgtttgcttgcaggagttttgtcttgttttgtttttgcgttagaataggtcttatttgaggttttatatgaactgctagagcccagaacattatatattctgagccaaacattactgtgttatgcacccacttgagtcatgtctttgtatcatatgtgacccatttgttatagggttttgatgcaagtagcttgtcttttagagggggcatggagatcattttttgaataagtaacaaaagtaaattttcattcaactcatttagacatgaaggtttcttagtatttgttttaatgaaaatctcagtttctctatctcccctttatctttctcacttacttaccttggtttttaaattaagtaggacttgttaaaaactcatcattattcatgttttacttataataatcagttgtcttcatttcatttatccaagcttgttaacttcttcccatgaaatatatcactacaggactattcattgttctttacctttgcttttgctttcattgtgtttggtatggtaagaaggatttaccttattggatataattgtacagatttgtattggaccatttacagctcttatcagaacctatgtgccctagcagcaaactgagcaactagcaagggctaagaaatgttttatgattatttgtcaatttttaaatcactgatggtatttaggtatcttttcttacagtctttctatgcatgtgtgtgtgtgtgtgtgtgtgcgtgtgtgtgtgtgatgtttttataatctgagcgtttcctgatattctcaaatatttcaaggacataattttaaaagagatgcatatggctatatcaacatttatttaatcatttctttattgttgaacatttaaattatttctgtttctctgcttttataacaaattgaaaaacctctgtaattccttaacgtttgtgggcctccctgactgtttctgtgggataaattcttaaaaagagaattacttggtcaaatattaagaatattcttaaagctattgcaacagatgtttaaatgcccgcaaaaaggttgtaccaatttatgtcccttggtatttgatggtttttgctataatatggtgtaaaattttgtcgttgaagcccctggtatgtttgtctccttaacgatgttcttctcagaataagcaggtgagaatcacctttgggttctcttgcaagaatagtaaccagtttggaataatgatgtatcataacaaccgactcataaaatcttttgagaaggtggggtgccaggtgaaggtgagtagttaatatttctttgtcataggaggctgaaaagagtaggaagagaatttaaaatttgcaaaggggataggctcattaatggcttttactcccatcttatgatgcttattgaattctgatcctggaattgtgttaccagtgagctgtcttgtgttgaaatctctttctaactctcattcttcagctgttaatcaacccaacaactttactgaatgcattttctaagtagctgtcaataagaggcagaattagaataccagcaagcttaccatgtgtgtcagcttatttgtgttttaggtaactccattttcttggagagacaataaggcatagtggaaggcatataaaatatggtggttgaagaccaggatttgggtcctgaattttccatttacaagctgtgtaaccttggataaattgtttaatttatctgaagctcaatttcctgacctttatgtaaagtggaaacaacaataataagcatacctgctttgcctgcctcacagcttacagggttgagagatttaaatgggataaattatgtgaaaatattttttaaaccactctatacaaattttaccatcatctttaatgtcttaatgattatttaaagtagtaatgtctacaagtatcccttttattcctattttacagataagattgctaaagcacaaaaaatgatgaactgcttcaacatagtaagacagttatataaagcccaggatagctcgttttcagcctattttgttttcccttgttatagcacctttagacaactcgtgtttgtgttccagtccaattacacctttacttagtttcttccattaaagaattagaatatgatttaaatctataaaactcttgcgtcaacttgtaattaataattgctgtaagtgtgactctttagtagttgtttggtggcctatgtatgtgggaaaattgtttattttaatataggatcacacagaacccttaaaattgttttcagatgaatatttgtttcagttccttagaacagtagtatataaccttggttttttagcacggtaattctttattcaaatgcagtcttatggcagtcctggaatataaagcagataaaagtggaggtagtgtgggtgaagtagagatggctactaattgcagaagactcctagggatctatggatcatattttgaaaatctctgccctagaatttgtcagaatttctagttcagtttaatgcttgcagtctgttgatgtacattctaagtgtttctctagatcttgatggtcttttcttgcccatgaaggttatgtaacctttctattattgtttggaatcaaaaggaaatgcctccaggcagccaacagtaatgtaagtgttgaaattaatattttcttctaagccaactcgtggagaaggtgtaggagtaattggagtcattgagtgcaatttcctaaaacctgcctacaacaaacaagactttgagtataccaaggagtaccggtgagtcactcccaacctgaggtgcttccgttagtttgttcagatatgattctgttctctaaagcctctaaaaccatctctaaaaagcagctaaataagttaactgagaattacttcaaatttgttttccaagattagagataaaatgctttcatttttaaattaaagtttgctgaatgatatatggagtctcgttgagataaaccttacctttagaaattatgcaaagagcataggagtaatttggtaaaagatttctggggaaatgaaaagctttggaattgatcttaatggaaacagatgaatggatctgaagttatggaatacattggataaaaaaaagcagtttgaaatttgttccaaaaatttttcttgaagccagtgaacagatttagagcaaagtgatggaacagcaggaaagacatgtgctttcattaaagcatctagatttaatagggcaggcaaacaggtaagaatctgaaaggaactcgacattatggctgaaccagtagggatatttttcgaaaggagtttttaaagccaggttagaatagtttgtttaaaaaatgtcgagagggagatgggtctttatttcattaagtattatgagacagcttctatgtgccaggtactaaggatgaaaaataagactctttgatacctatgaacaaatatgtatgcaaataagaaacttaaatacttataaaataattgctttaatagggggtatgtgcaaagtggggagaactttaaatatgcttaagggagtcagggaaggcttcacaaagcagattatatttgatattaaatatgaaggaaaagttttctaggtggacaatagaggaaggacattctaagcagagggaagtatctgtaagggcaaaaaagggtaagaggtattctgggagtatggagaaagaaggcatgaggacatttgcggtcattttccttgaagtctcagtagcaaatatttttcttagagtgggagaaaagaaatttcccaaatctcttttgttttgtgcccaaactgtaataaagtcaagtcttgtaccttaatttgtctgtaaccacaagaattttaggtttagtgtttgagagagataactatttgaatggcaactccaaattaatttcagggtaattggttcatggttacttgggctactcagtggttatgacaactacctgccctcagtctaagtaaaatggtcatttaaatgtaaatctggcccataatggaaatctttgaccaggacttaactctaagtgaaagcttaggaatgacattagtttgacagaagtctccgagtcaagttattatgtttcaattgagtgaaaggaatagtgaattgctgatgactacctaaataattaagatttgtgaaattcaaatgttagatattaaaaattatttaacatctttctatatcatctttgccaccaaccccccaagtctacctttaaaattttacaggcattagatctttggtttttgatgtctagttttggtatgatgaggtgattgcagtggatcagatagagatagtctgtagacagtagatttattcagttgaacacacaggatttctgacttacttagcataacatctgctacacactttattaaaaacagggaactagtatactattctgcgtacagtcttttgaggataacaaatttgcataactcatgccaattctggcaccattgcccttttttattcaatttattttatataaaatgaaaaggtatttaaattaaaaaaaggaatttaagagagggattagagaaggttgtctgctataacaaactcatcctatgagtattatagatatcaaaacctgcaaatgataaaagagataccagccatcatactgctggaatgtctacaaataaatcatctgtaataccacttttaacagttgtggagcttacagtcatttgtataaacagattgtaacatatatgaagtaatttggcgagcaataaaaaagctctttaatcaaccaaaacctaagtagtatgttatggggaaaatgccttgatataggagatggggaaggttttgggtagaaagtatgacttgagatatgtctcacatgatataagatgtggaagagaggaaagggaattctaggatggaattgtagcatgagctaaggtagtgacaggaactcagaatggtaagaatatggagagaggagataacaggatatagctagagtgaaggcaaatcaagttaaatgagtagagtagagccataccccagagcagcagttggtaaactttttctgaaaagggccagaaagggtcacaactacttgattttgctgtagtatgaaagcagccatagacaataagtaaaggaattggcatgggtatgtctaataaaattttgtttacaaaaacaggcagtgggctggatttggctccagtttgctgacctctgtcctagaaccatcattcctaaattacatactaagctacacataatgaattcataggagagccatgaggtattttacatctttgagggaaatacagtgatactcaacttctgtctataaaccacagaaattgtcttctattgctgtcataacaaattaccacataacttagtggctgaaaacaatactaatttactgtcgtagcgtgctgtaggttggatgtcctacacagatcttactgggctataatcgaggtgttggcagggctgcattcctttctggaggctctagggaataatccattttcctgtcttttccagcttatagaggctgccagcatttcttgcccatggccctcttccatcaccttcaaagctagtagtgacaggttgagtcctcatattgcatcactctgatgaccttgcttttgtcatcacatcttctctgattctgactcttctgctgcactcttctacttttaaggtcccttgtgattacattggataattcaggatattcttcctatcttaaggtcaacttgatgagtaacctaaattcccacttgctgtgtaaacattattatgtctatcacagtctgccctttgttctctcagattccacttacatctcatatgcaaaatatattcaccccgtcccaacgtttccaaaagtccctacccattacagcatcaatgcagagtcaaaaatttcatgtaaatgtcatcagctcaaaagtctcaaatctcattatctaaatcacataagggcaatactctgagtatggcacatcttagggcaaaactcctctacatctgtggatatgtattttcttttttgtattttgctgttaaagtacagtggtgggacaagcataggatactaattatatatattcttgtttgaatgggggagaaactaaaaggaaaaaaggggtcacaggtcacaggcattttcaaaatctagccaggcacattccattaaatgtcaaggccttcatcctctagtcttgaggctttgccctctggacttagggctccaccctcaaagctgtctttcctttttcctgaagggtagcatgtgttggcagctgagtagtttcatcagcctgtttcctgactgtagaattttgagggtcaaacaggattctctccatccctttcaattcaagctagctttttgttttgattttttgtttgtttgtttgtttttgagatggagttttgctcttgttgcccaggctggagtgcaatggcaaccgcaacctccccatctggggttcaagcgattgtcctgcctcagcctcccgagtagctgggattacaggcatgcgccaccacgcccggctaattttgtatttttagtagagacggggtttctccatgttggtcagtctggtcttgaactcccgacctcaggtgatctgcctgcctcggtctcccaaagtgctgggatttcaggtgtgagctactgtgcccggcctcaagctagctttcatgctagcgtgccattcttaagaaccttgtgagtctcccatgcgtgtcatgtatattcatgtcatccaacaagaggctcttggcaggtctttcctagggaatcctatatctattttttggctccagctgagatggctatggagatctgtgagtcacaggctttatcttttttttattattatactttaaattctgggttacatgtgcagaacgtgcaattttgttatgtaggtatacacgtgccatggtggtttgctgcacccatcaacccttcacctacattaggtatttctcctaatgttatccctcccctagcttcccaccccctacaggcctcagtgtgtgatgttcccctccctgtgtccatgtgttctcattgttcaactcccacttatgagtgagaacatgcggtgtttggttttctgatcttgtgatagtttgctgagaatgatggtttccagcttcatccatgtccctgcaaaggacatgaactcatccttttttatgactgcatagtattccatgtgtatatgtgccacattttcttaatccagtctatcattgttggacatttgggttggttccaagtctttgctattgtgaatagtgccacaataaacatacgtgtgcatgtgtctttatagtagaatgatttataatcctttgggtatatacccagtaatgggattgctgggtcaaatggtatttctagttctagattcttgaggaatcgccacactgtcttccacaatggttgaactaatttacactcccaccaacagtgtcaaagggttcctatttttccataacctctccagcatctgttgtttcctgactttttaatggtcgccattctaactggcgtgagatggtatctcattatggttttgatttgcatttctctaatgaccagtgatgatgagcatttttttcatatgtctgttggctgcataaatgtcttcttttgagaagtgtctgttcatatgctttgcccattttttgatggggttgtttgctttttcattgtaaatttgtttaagttctttgtagattctggatattagccgtttgtcagatggatagtttacaaaatttttctcccattctgtaggttgcttgttcattctgatgatagtttcttttgctgtgcagaagctctttagtttaattacatcccatttgtcaatgttggcttttgttgccattgcttttggtgttttagacatgaagtctttgcccatgcctatgtcctgaatggtattgcctaggttttcttctaggatttttatggtcctaggtcttacatttaagtctttgatccatcttgagttgatttttgtataaggtgtaaggaagtggtccagtttcagttttctgcatatggctagccagttttcctaacaccatttattaaatatcgaatcttttccctattgcttgtgtgtgtcaggtttgtcaaagatcagatggtggtaaatgtgtggtattatttctgaggcctccgttctgttcctttaatctgtatatctgttttggtaccagtaccatgctgttttggttactgtagccttgtagtaaagtttgaagtctggtagtgtgatgcctccagctttgttcttcttgcccaggactgtcttggctatgcgggctcttttttgcttccatatgaagtttaaagtaggtttttccaattctgtgaagaaagtcagtggtagcttgatggggatagcattgaatctataaattactttgggcactaaggccattttcacaatatttgttcttcctatccatgagcatggagtgtttttccattcgtttgtgccctctcttatttccttgagcagtggtttgtagttcttgaagaggtccttcacatccattgtaagttatattcctaggtattttattctcttagtagcaactgtgaagggcagttcattcatgatttggctctgtttttctattattggtgtataggaatgcttgtgatttttgcgcattgattttgtattctgagactgctgaagttgcttatcagctcaaggagattttgggctgagacaatggggttttctaagtatacagtcatgtcatctgtaaacagagacaatttgacttcctctcttcctatttgaataccgtttattgctttctcttgcctgattgccctggccagaacttccaataccatgttgaataggagtggtgggagagggcatccttatgccagttttcaaagggaatgcttccagtttttgcccattcggtatgatattggctgtgggtttgtcataaatagctcctattattttgagataggttccatcaatacctagttttttgagagttttagcatggaaggctgttgaattttgtcgaaggctttttctgcatctattgagataatcatgtcgtttttgtcattggttctgtttatgtgatggattatgtttattgatttgtgtatgttgaaccagccttgcatcccagggatgaagccaacttgattgtggaggataagctttttgatgtgctgctggattcggtttgccagtgttttattgaggattttcacatcgatgttcatcagggatattggcctaaaattttctttttttgttgtgtctctgccaggctttggtatcaggatgatgctggcctcataaaatgagttagggaggattccctctttttctattgattggaatagtttcagaaggaatggtaccagcttctctttgtatctctggtagaattcagctgtgaatccatctggtcctggactttttttggttggtaggctattaattattgcctcaatttcagagcctgttactggtctattcagagattcagcttcttcctgctttacacttaggagggtgtatgtgtcgaggaatttatccatttcttctagattttctagtttatttgcgtagaggtgtttatagtattctctgatggtagtttgtatttctgtgggattggtggtgatatcccctttatcattttttattgtgtctatttgatccttctcccttttattctttattaatcttgctagcagtctgtctatttcgttgctcttttcgaaaaatcagcttctgagattcattgaatttttgaagggatttttgtgtctctatctccttcatttctgctctgatcttagttatttcttgccttctgctagcttttgaatttgtttgctcttgcttctctagttcttttaattgtgatgttaaggtgttgattttagatctctcctgttttctcttgtgggcatttagtgctataaatttccctctacagacagctttaaatgtgtcccagagattctggtacgttgtgtctttgttctcattggtttcaaagaccatctttatttctgctttcatttcattatttacccaccagtcattcaggagcaggttgttcagtttccatgtagttgtgtgattttgagtgggattcttaatcctgagttataatttgattgcactgtggtctgagagagttttttgtgttttattttacatttgatgagtgttttacttccaattacttggtcaattttagaatgagtgctatgtggtactgagaagaatgtatattctgttgattcgtggtggagagttctgtagatgtctattaggtctgcttggtccagagctgagttcaagtcctggatatccttgttaattttctgtcttgttgatctgtctaacgttgacaatggaggggtgttaaagtctcccattattattgtgtgggagtctaagtctctttgtaggtctccaaaaacttgctttatgaatctgggtgttcttgtattgggtgcatatatatttagggtagttagctcttcttgttgaattgatccctttaccattatgtaatggccttctttgtctcttttgatctttgttggtttaaggtctgttttatcagagaccaagattgcaacccctgcttttttttttttttttttttttttgctttccatttccttggtagatcttcctacattcctctattttgagcctgtgtgtgtctttgcatgtgagatgggtctcctgaatacagcacaccagtgggtcttgactctttatccagtttgccagtctttgtcttttaatttggcatttagcccatttacatttaaggttaatattgttatgtgtgaatttgatcctgtcattatgatgctagctggttatttcacctgttaattgatgcagtttcttcatagtgtcaatggtgtttataatttggcatgtttttgcagtggctggtaccagttgttcctatccatgtttagtgcttccttcaggagctcttgtaaggcaggcctggtggtgacgtaatctctcatcatttgcttgtctgtaaaggattttatttctccttcacttatgaagcttagtttggctgtatatgaaattctcgtttgaaaattcttttctttaagaatgttgaatattggcccctactctcttctggcttatagggtttctgcacagagatccactgttagtctgatgggcttccctttgtgggtatcccgccctttctctctggctgctcttaacagtttttccttcatttcaaccttggtgaatctgaccattgtgtgtcttggggttgctcttctcgaggagtatctttgtggtgttctctgtatttcctgaatttgaatgttggcctgtctttctaggttggggaagttctcctggataatatcctgaagagtgttttctaacttggttccattttcctgtcactttcaggatcaccagtcaaacgtggatttggtcttttcacatagtcccatatttcttggaggctttgtttgtttcttttcactcttttttctctaatcttgtcttctcactttatttcattaattttatcttcaatcactgatttcctttcttccgcttcatcaaatctgctattgaagcttgtgtatgcttcacgaagttctcatactgtggtttttagctctatcaggtcattaaagctcttctctacactggttgttctaattagccattcgtctaaccttttttctaggtttttagcttccttactatgggtcagaacatttcctttagctcagagtagtttgttattacccaccttctgaagcctacttctgtcaacttgtcaaactcattctccatccagttttgttcccttgctggcaaggagttgtgttcctttggaggagaagaggtgttctggtttttggaattttcagcctttctgctctggtttctccccatctttgtggttttatctacctttggtctttgatgttggggacctacctacggatggggttttggtgtggatgtcctttttgttgatgttgatgctatgcctttctgtttgttagttttccttctaacagacaggcccctcagctgcaggtctgttggagtttgctggaggtccactccagacgctgtttgcctgggtatctcacgagtggaggctgcagaacaaatattgctgcctgatccttcctctggaagctttgtcccagaggggcacctgcctgtatgagatgtctgttggcccctactgggaggtgtctcccagtcaggctacacgggggtcagggacttacttgaggaggcagtctgtccgttatcagaacttgaacgctgtgcttggagaaccacttctgtcttcagagctgtcaggcagggacatttctgtctgcagaagctgtctgctgccttttgttcagatatgccctgcccccagaggtggaatctagagaggcagtaggccttgctgagctgtggtgagctccgcccagtttgagcttccctgctgctttgtatacactgtgaacatagaaccacctactcaagcctcagcaatggcagatgcccctccctctgccaagctcccgtgttccaggtcgatttcagactgctgcgctagcagtgagcaaggctctgtgggcgtggcatccaccaagccagacacaggaggggacctcctggtctgctggttgcaaagaccgagggaaaagtgcagtatttgggcagaagtgtaccactcctccaggtacagtcactcacggcttcccttggctaggaaagggaaatcccctgacctcttgcgtttccccgtgaggtgatgccccgccctgctttggcttgccctccatggtctgcacccactcttcaaccagtcccaatgagatgaaccaggtacctcagttggaaatgcagaaattacctgtcttctgcgtcgatctcactgggagctgtagactggggctgttcctattcagccatcttggaaacgctcactttatcttttcaaagagtagtttgtgtgactgaatgctctgaccttttgattttctgagatattatcaaaagattgttcagccccagcctcagctttttctctagagcatactttcctgacagtgaatctctaaattttagcatattttgcaatctggatgggctgagaatttcccaagtaatcaagtcctggtttctttttgtttaacagttcattcgtcaatttgtctctctcctcttgcattttacataagcagcaagaagacaccaggccacacctttaacacttttcctgaagatctcctcagctaaatttccaatttcatcatttgcaagttctgttttccacataactgtaggacagttctgctaagctttctgccactgtgtaacaaagatcatcttctctcaagttttccaataacatgttcgtcacttccttctgagccttcactagcaatacctttaacatccatatttctaccaatactcttgtttacaatgatttgggtattctctaaggtaatttgtgttttctctaccgtacttttcacttctttctgagccctcattagtgaaagcatttattaacatatatatttctactaatgtctgttgaaggcaatgtaggtttttttctgtcaagcttctcaaaatttttgcaacctctgccaattgccaattctaaagccacttccatatttttaggtatttgttatagtagtacccctcttccaggtagcatccgctacattctttttcattatatcgtatctttgtgaatctggatttaatccatttacattaaagtaattactgataaggagagacttacttctgtcattttgctgtttgttttctgtgtcccttgtagctttctttgcccctcatttcctacattgccgtcttttgtgtttaggtgattttttttatagtgaaacatttaaattcctttctcatttcgttttgtgtatattctatagctattttgtttgtgcttatcatgggaattacatttaatatcttttaagttatgacactctaatttggatgtatactaccttaacttcaattccttacaaaagttttgctcctttaacagctccatcaccattcctttcagttgttatcacagaattacatctttgtacattgtgtgtccaaaatcataagtaatttgtaatggattagccttttaaattgcgtagaaaacaaaatgaggagttacaaactgaattacaataatactggcttgcagactcaaaatttttatcttttctttcttttttttttttttttgacatggagttttgctcttgttgcccaggctggagtgcaatggcaccatcttggctcactacaacctccccttcccggttcaagctattctcctgcctcagcctcccacgtagctgggattacaggcatgcaccaccatgcccagctacttttgtatttttagtagagacagcgtttcaccatgttggtcaggctagtctcgaactcctggcctcaggtgatccacctgcctcagcctctcaaagtgctgggattacaggcatgagccactgcacctggccaatttttttcttttaaatgtattctcttacattatatagaaaataaaaagtggagttacaaacttcaaggattccttgaatgtaatatgttgtttctctcttggtgtttttaagattctctctttgtctttgactttcatggtttgattacagtgtgtctgggtctgagtctctctgagttcatcctacttggagttaaggttggatgtttatattcgtgtctttcatcaaatttgagaagtttttggcaattatttattcaagtattctttctgttcctttctctcttctctttctgggactctgctaatgcatatgttggaccacttatggtgtcctatgggtcccttagtttttgttcacttttcttcagtctattctttctgctcttaatacttgataatttccattttttatcttcaagttcactgattcttttttctgtctgatcagatctgcctttgaattcctgcggtggatttttcatttcagtttttagacttttcagctccagactttgttttggatttctttttaggtttgttatctctttgttgattttctattttgcttatgcattgttttcttgactttctgctcatcttcatatagttttttgagtatctttaagaccgttttaaaatctttgtcgagttgatctattatcagttctttttcaggggtggtttctatttttttcctttgagtgggccgccctgtcttgtttgtttgtatgccttgtgactttttgttgtaaactgaacatttgaatctaataatgtggtaactctggaaacaaaattctcctttcctagggtttgctgggtttttttttgttgttgttgttgtttttgttatgttgtaggctttctctgtgccaaggattgacctgagaagtaagtttaaagtcttttcacttcttttctcagcttgcatttttttctgggcattcacagtggctttctaattttccccatatgtgcaattgcttttgaatgtccttgtctttatgtctggctcacaaaagggggaaaatagagaaatagaggaggaaaaagagatgccaggactttgaatcctctggatgtcacttcaactggaggagtagagggttgaaacaatgggggaggttcaacaacaatggtctcttgcctttttgtcttcacatctgtgatcagaagcagcaagcagtgatcagaggatagaattgcaatatttggaggacagtgtcctttttgcccacactggctcctacaagttgctcttggaacacatggagggttgcttgccacagggctgggagtggggaatgggtagctattactgagctaagaactgaaattgaccaaaattaaccacaatttaccatccaagccttctcctggaagttgcaaactttccaatagactccagagtttcaaaatagttacatcatgcagcttttgctactgcagttgttgtatatgtaaggagacagcttccacatgcttcttattctgccatcttcccatatgcccatctaatctacttctttttaaagtagattttaagtagatttttaagaggaaatgaggaatagttcttcatctgtgacttgagggaaggatatagacatagagtaggaacataaataggttgaaggggaataagagtttataggggagctcatatatgattactttaatcttttccatttagtgagaatctaatttaatatgaataaggtagagataaggaagagtttctcttaacaagagaagagctctgcaaaaaccttggggaatgatccagggggccaagatatttaaaaaattctgaattctaagtgtacagttttccagttgtgtgtagctctacattaggttgtaatctcgggttatggaattaaataggaattagtaattcgaaagttggaagtttttaaaagtaaaattcaggttttgatttttacaaattacatttttgttgaccctgagtctactgttgttcctttagggagagaaataaagagcaagggctggaactcagatacagcctccagtaacggctatgtggtagaatgttggagtgcttgttcatgggcaccataatgctactatgatcagcatttggatgaagagggactatatagacatattagagttaatatttgattgatttataatagatagggtatagtatttgatcatctgatttttaccttgttctgaattatctacctgtagtcatctgacaatcaaataactccccatcaacttatcaatatttggctctatcctatctctgcagtttggtcctctgtcatagtctctaatgtcaagttacccatacactccatgattcaacaagccctgaaaatttatagaactctactttttagcacttgtgaccatttcaccttttcaaccaaagtgactgttcagtgttacaactttgtcattttgacatgtagcttgcaaaggcaatggattcccatcttggtttcttaaagtgtagatgttcaaaaatatgccagatactctaaattattggtgtctgttaaatgggaacttctcaaagatcaaagaattgctcaacaagtgctaaactttgacatacttcttgcattttctttcaggctaacaataaatgcccttgcccagaagctcaatgcttactggaaggaaaaaacatctcaagataattttgagacctcaactgtagccaggccaataccgtaagtaatacatacagaatatgaatgtattaggggtaatatccatagatcaaatggaaggaacaagggtaatgtgtctggatttggttcctgctggtgggttcgtggtgtcactgacttcaagaatgaagctgcagaccttcgtggtgagtgttacagctcttaaagatggcaccgacccaaagagtgagtggtagcaaggtttattgtgaacagcgaaaggacaaagcttccacagcttggaaggggacctgagtgggttgccactgcttgctggggtggacagcttttattcccttattgttccctcccgtgttccatttctgtcctatcagagtgcccttttttcaatcctctctgtgattggctacttttagaatcctgctgataggtgcgttttacagagcactgattggtgcgttttacagagcactgattggtgcgttttacaatcctcttgtaagacaggaaagttccccaagtccccactcgacccaggaagtccaactggcctcacctctcagtaagatggtgcttttcacatcaggaagtttaattgactaaaaataggaactcacaggtactaattgcttcattctctaaacctcttcattctgctttaacacatttacggtctggatcataaatgtgaagagtttagtactggtagtgtgatatagtagaagatgatggctatttaaatcaaacgttcctgggttgaaaatctggatctgctttttaatagttggatgagcttgggtaagtaagttacttcacctgtctgaatatattaacttaggtgacatacatttttagcacagtgactggcatatagtaggtgttcagacatgttagtaaacttccccttttttttatattcctagtgaatattgctgggattgtaccagtacttgagagtaggaatagagaacccagtatgttaaagaaaaggtagaatttattgactctaagacagacaagtcaggtaaggagcataatacagaggatcgaatgtgtgccaacacatacacagtcagttacaccaccatcaagacaaacattagagtggtaaaagttctttttggagtaggtacctattattttaatggaaattattaggcaaatgtatgatataaaattttatttctaatgcaacctaatggctgtatgtatatcaccctcttcttattctgaagatctcagcttatggctgtcctccatagttttcaaagaagtacaaactaagatgagatgccattttttgcctttcaaattagcagtgattaatgcaatgaaacagatgttcacatactgctagagagtgtgtgtgctggaggcagaactgtaataatggtaattattgaacgcttacttatatgtcaggcactgttctaagttctttacatgcagtggtttatttaatcatcacaacaaccctacctgttagatattattattacttctttacagatgtagagactgatacaccaagaacttaagtaacttgcctaaggttagacaagcagcaagtggtagaactaaggttcaaatataggtaatcaggtcccctaaacctaagttcttaactgctgctctcttctggagggatgcaatgaagggaatgtagtaaagccatctcagctaccaatttcctgaaagcatgggctaaaagcctctcctgtctgcctggattgaaggatctaccatgatctgcatggaacccgaaacagagggttgctgcctctaagcatgcctatccctgagagagtaatactggcactctgcaagagactctcctatgcatatgcatgtagaaccgaagctaataggacctttcttctcccctcccactactgctgaagctgctttttattgactctggctctaaaacagtggctgtctagaaatatatagacaccagaggtcaggcctgagcttagagcttagaggttgcaaggctggaacagcctggagctagggaataggaagctgtagatccaaaaatgtgtacaaactttctttgttcaaacagagtttcaaaaaaagaagagggcattgtatttcagtggtagaattatgagtgccttttattttctgtatatatttctctattttctagtttttaataatgagcttatattacttttatatttagaaaaaagcacaatttaaagccaggcacggtggctcatgcctgtaatcccagcactttgggaggctgaggcaggtggattgtttgatctcaggagtttgagaccagcctcggcaacatggtgaaaccccatctctaccaaaagtacaaacattagccgggtgtggtggcgcatgcctgtagtcccatagctacctgggaggctgaggtgggaggattacttgagcccaggaggcagaggttgtagtgaactgaaattgtgccactgcactccagcctgggagacagagtgagaccctgtctaaaaggaaaaaacaacaacaacaagaagaaaataaaaagcacaatttaagatgttaagaaaattattgaactaagacataaaagaaccgcaccactctgttgaaatatctagtataaaagaagtataaatataacatgcataaatctcatcctaggctaaattacatgttagtgaaattggctgaggtgcccctcttcttgctttgtgtgtcttttctccagccgccttcattctcactgtagcctgtcttttacaccttaggtactgagtacttctgtcatataaggaccactttctcagagaaacaaattcactctaaagtgtaggtaactgaggggaatcagagtgggtatgcattttaagagttgaactctggaagagttttatcttaatttaaccccattgctgtctggaaccaccatttctagttatgaaatttaatcaaatttatattactttttaagattaactttgggaatatcaacctagtaaaattttgattgaagtattataagcaaagggtttttcttgagagggaaatgaaaaggaataaggagtctctgtagggaaatgagggagatgttttaatggcaatgcttccatggctgtcataaatggattttaagcctgttacatgattggacagaaggaaacaaaatgattctatgggttttatttcttggtaatatagtaataaacagaatttttccaagttaataaattttagagttaaaattaccctattgtttgcttggaacaagagccaccaggataagtattatttaaaaaatgtttcaatagcttttggggtacaagtggtttttggttacaagataaatattattgacctctataaaagtagctcaccatgttaatacttgttactatttttcatatccatatttgctatagttctatcattttatctgtgaagttaaaaatatatacatttgggcaccaagatgataacattcccaacatatttcatatatgaaattaggttctttctttttttggctgcacctttctaatgtaagacaaagcacagagctaagatatacacagtcacacttccattttccttcattcaggaaggttcctgaccagacatgggttcagtgtgatgagtgtcttaaatggagaaagcttcctgggaagattgatccatccatgttacctgcaagatggttttgttattataattcccatccaaagtacaggtaaggttccaggactcaatcttatgctcaaggtaactcctgatttatctctatagtctaaaacatttttcatctcaggttcacacccttcagcctggcattcaaggccctgtgctgactgaccccagcttacctatctagccttacatttcgtggtatcttaacacaaactttgtacttgagccagggctgtggcttcactattccctacacatgccatgcttactctcatgtccatgactttgatagtgtcattcctcttgcttgcaatgactttctgcattccatttgtctatcctaatcacatccatctgggcagcaagtgttttgtgtgatgcttttcctgttgaccatagtttacagtgattttactctgatttcctctggtatttgattcttgacatttgttcacatattgttttgtactttttggatgtttttcacatatgtatctttgaagagctttggctcttcaagagatcgtaaactcttcgagacaaaggactttacattccaggtcaagtcgatgatgttctttatatgcttcgtatttggaatcagtgttatacagtagtacctgtacctattgtatattcagcgctgtttgtgtgtttgtcttcctaatataccatatgtttcttgcagcatccaacatctaaatagtgtctggcatatctttaggcattaactttaaaagtttttaaaaatttgactcagtagtcatataggttcataataataagtcagtgtgcttcaattcagctgtgactttcttaaaattcttctggcaggataaatactgatagaaaggtgctaaaatgggtatgcattttaggggaaaaatgtctaaaattgaagaagttaaatgaacaaagattaggtctataaatataagcatttcctcatagtctctagatatgcccaagtatctttccatggagagtaaatgagattgtgtaattagaatatggaactgagtacttagaagtctcgtttttgaatactttatcttttagtacaggagacataaccttgcagcccactttgcccctttataaactgagtataatatagctgccaattattgttaaattttgtttgtttctaggattacttttgaccactgaatgtattttctagtactcctttcagtttttactcctaaaattctctttctcatgctttacatataacaaggttttataatttgaatgggatctgaactctgtaatgttagagagttgttaacctgcatagttataaggaaattaaaaggtaaaagtgaaggacccagtttttttccaaaggatgatttattctctgtactgcaggagatgctctgttccagaggaacaagaactcactgatgaagacctgtgcttgagcaaagctaagaaacagttgagtatacatgagatggggttctctaccatagggtagagtagcctgacacttccttacaggacgggagttttgagaagagagaatttttttggttcttaaataatttccctcctcacctctctgctctcccagttctttattccttctaatcatctcctgaatgtctcaactagtgattgtctttagtctttctctctcctctctctctctctctctggtggggcacttgaaatctcacttcagtagcctagttcagaaaggcaccctcagttactcaatgaggctcacagtatttgtaatttggaaggaacattataacctaaatctacaattggcagtccatttcaaactgagaagtttcatgagtgaactaaatagcacttttatcttctcctagagaacaaactgttgaggagaagaagaagatgcctatggaaaatgagaaccaccaggtgagaggcagtgcacacccttattgttctcacacaacattttccccaacagaaaatataagttgaaggaagcagcaatcttgaaagctgcatagaaataacaaaccatttcttctggtggtcttcttttcattgaatcttttggttttgctttgctctgctgtcactgatgtttagatcaccaaaagtagaagagtcgaatcgtttatcttccagatttggattcagtactgactctggacagtatgaatatcacattcaatgtcacagaatattcagggttgtgtttcatcctcatacaggcttctcctgttaagtgtctgcttttcctgtctcttttcttctaggattcaggggtgatcccttcctccttcctcttgggaagaaggggtggttgtttgtactcctcccctatccctgctttcaggctggctggctttataaaaattctgctgttttgaattttcaggagcactgtctctcggacatggttgcccagctccggacgctgaagggtgcagtaaggttggccgtcctttcagggacactcctttcctgacagccaccatagcacccgtatatctttccctcccaaccttgcctttctgcatgatttccctcttgaccctctttccaagagagatctgctagtcgcatgttagattcaccttccactcactcaatcagggtaggtcagactggtgaggatagaggcaatttaatactaattcttcttctgatatcctgccaagacccaggcatatgaataatcaggtttcataccctaatgccttggtttaattgtctgatgtagagattggtagatttcctaggactgccctgttctcattcagtttacctcccctatattttccctcaccttaatcattcatactatcttcatgagctggctctcccacaagatccagatgcatgtctgtgtgtgtgtgtgtgtgtgtgtactatgaatatatgttagtctgtcgcatgtatttctcccaaactggcacagacacttgctgcagtgcattttcccaccaccctaccctcatcatacatctcaggggagtgaaaactcagccttaaactgggtcacaagagagaattagacagtgattagggggcctgggtttatattgggggtgggataattctaggagccactaagtaagttgggggaggtctgtttggtgtcctgctgataaggttgataactgagtatgcctgggttcagtgttctagtgtacattactgcacactgtttgttttgtgtaggaaacagtttctttttatttggccaagcattctttcctagcatcagaaggattgactcatcctttggcatttggtttgaatttgagacttttacaaatcatttctgtcttttataggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccaggtgactaaaaagcatgatctcttgtcaatagtaagctttagagtctgttttcctgtagagtaagttggtatgttttaccttgtttctgttttttctaaggcctagcatggaattcagaagtagaaacacaattttaagttgatagaattgtgtgttgcatgtacctccaatttttcagtattataactgctgtatcaggtctataattttgaggtgatcatttgctgatactctttttatgtatcatgtattcacattatattgggaattgtgcaagtgaaataatagacaaaatttgaaaagtgtaaaatactacacaaataaggtaatgttataatgataagcattgttccttttcttcagtatatggatattgaagttctcttgggcctcataggcctagcacatgttgaccacatgtaaaaataactattagatatttgtgccattaggtaagctttatcatttgttgtttcctagaataaattattagtataagtttagcattggactttacttgttcaccttctagcacctcatcagtgttattttgtgtcttcataacaagaagaagcataactgttctttttcttagatatcaggagtatttgaagcactgaaggatatgactgcccctttactcccatgggactgaactcagtactcctaattatgactccttgctttctcttctctattctgcttctcactcttgcagggccaagccatatagggcagggacaaggttgctctctaatagtagaaatgtctatgttcatcagtaatctgactattatgtttcgctcttgttgcccaggctggagtccaatggcgtgatcttggctcactgcaacctccccgtcccgggttcaagcgattctcttgcctcagcctctggagtagctaggattacaggcatgcaccaccacacctggctaattttgtatttttagtagagacggagtttctccatgttggtcaggctggtctcgaactcccgacctcaggtgattcacccgccttggcctcccaaagtgccaggattacaggcatgagccaccacacccagccgggaagtgaactttttagtgactattttcactttggatatctccttaacatactgtagaatagtcagtggaatacataataggataaagtgactcctggttggttggtttgtttttctctgtgtttctgagttcaagaccagcctggacaacacagcgaaatctcatctcttaaaaaaaaaacaaaaaaccaatagaacggtgccttggaatatagtaggtactcaataagtaatggttgaatctgagtcatatttaagaagcaatttctaagattgaattttgtagcaacgggataagaaatagaatccagccttagtctcaggagcttgagcctaattacaccgtttccatgcatacttttccaactcccattttaggttgggaggggtgcactgtaaatgctaagtgtttttgaagcacattgttacctttttaccctggtctcctggagatgctcatatatcaccattgctgctggagtgtcaggtgtctttgcttttgaagactgtcccttccttactatgaccacttttcctttttttccagtgtttcttttataaccctgtagtggtttttggtaacctcaaggggattacaaatgctaatttatatacttattttatgaatgcagtacaatagaacttccattgggtggcatacttcatcagtctctattggaatttttgtatgagtctttatggattgctatatcgagagtgaggttttggctgtagaggacaggtaaagtacattgaccattcatatgtaattttaatttattgagaataaaattatttcaagagaaagagaaacataagaggtatgtgatagttgctgttgctaatgtcatatatgttacataagatcagtaaatgatgattgtgtcatttcaagttacacttttcgagggaatcacattgattgggctgagactaccttttaatgggggaaaatggagttactcaagagtctagtaaaatatataggatttctgataaaacattaaggtttaatcaagagttacaaaggtcttctgttattatcagcataggaagctgataagggtccttgggtcatgtagttcagcttactaactccagataaaataaagcctacagtatccaagaaaacttttaagttctagtgggtagtttagcaggggcgccacaggtgtcactggaaacagctttgtgagtcccacaaatctagcaaggggaggagaggacctgcaataaagaataggttccaccagtatgtaagcaggtataacctttttggggaagacagcttatttctgttaaaggaaataatccctttctatttgttcatcctacatgtataatcgtgccgcataatgacatcttggtcaataacagaacacatacacaacagttatcccataaacttacaatactgtatttttactgtaccttttgtatatttagatatatttgatatgcaaatacttaccattttgttacagttgcctatagtattcactacagtcacatgctgtacaggtttatagcctaggagcaataggctattgcctaggtgtatagtaggctataccatctgggtttgtgtaaggatactctatgatgtttgcacgatgaggaaattgtctaacaatggatttctcagagcgtatgcccatcattaagtaatgcacgactgtatttgagtgcctactttatgaaaggccctgttctagggtagtgacaagatcaaagatgaaggaggtttgagtagtcaaaatttgatatgtaagtatccccaatatttacatataaagtgcatatagttttctttccttttttttttttttttttttttttttttttgcggcagagtctcgctctgtcacccaggctggagtgcagtggcgcaatctcggctcactgcaacctccacctcccgagttcaagcgattatcctgcctcagcctcctgagtagctgggattacaggcgcgtgccaccacgcccggctaatttttgtatttttagtagagacagggtttcaccatgttggtcaggctggtttcaaactcctgacctcgtgatccacccgccttggcctcccaaagtgctgggattacaggtgtgagccactgcgcctggctaaatatgtatagttctcttatgagtgatacaaaataagatttaaagtggccgggtgcagtacctcacgcctcttataccagcacttgggaggctgagacaggagggttgcttgagcccaggagttcgagactagcctgggcaacacagtgagacctcttctctacaaataataaaaaattagccaggtgtggtgacgtgcgcctgtggtcccagctactctggaggctgaggtgggaggatcgcttgagcataggctgcagtgagccagctgtgattgcgcaactgtgctctagtctgggcaacagagcaagaccctgtctcaaaaaaaaagaaagatctaaagtaaccgtaagcatttgaatgaaggcaagaattagtggctgtaatttatttagatatttagatttgagtaagctatatgtcaaaggctaattagttcatatttttaaaggttaacaaattctgaattgcactgttaacagtggagggagagaagtagagacattctactgtgtctaaaggaatacttgaaataacaaacaaggggtagaaatagatgaacaattttgcaaatgaataagattgattcaggggccagtattaacatttaaaaatatgatctagggaagcaacttccagaatggagaaatgaggagcatagtggactctgtcaccaataaataactgtttaacttgaaaaaatatatttaaaaaaaatcagtgtttctggatagtgtcctaggggcacacagcaaagggagaaatattcaagaaatcttctaaatctcaggaagaacagcaagagtcagtggcatttgaaccacaagctgtcccactccaagctctattttatgaaaactactcaaaggaattctaatccatgtgggtgtggtctagaagatgggggctccctcatcccctagctcattgtctagagctatggttttacctgggaggagcaggcctctggcttttctcatctcctctccagttctgttttgtagaagctctattccaggcagatccacgaagactgggtctctcttctcccagccttctcttccccaacaaagccctcacttatagggtgggagcactcacaaaggaacagcaagttagtaataccatgcccctattgttcctacccgagcttgctcataggtcagaagtctatgctggaagaagtaagccaaaaattaccccagtacccattcataaagaagggattttactctgggagaagtatgttactgttgttgtctctagttcttgcacactgtgccagagattctgcttaaagagagaggcaggccttaaggatgaggaatgccacagctctacctaaaggaattgactttatgtggagcagaacatgaagaattctgtgactaaggggcattgtcaaaaataatggagatcttggtggagaacaattatgagggcaattataactccatgacaagtttcagcaagcaaaatgtgcaagcgatcataagtttggtaacagagagaatcagggaaatacagtcaagagccctcttcggatcatagtcttgggtgtcagaaaggctgtgtataagcacagggctacacccactcagaagcaatcagagcaggacctaaggtggacttgaaagccgtcctcaagctgaacacagatgaaacagtaaagaagaggagcctcactggcactaggggtttaagcacaacctctaaccaaccactggctgaacgatgttactctgacccaggggcacctcctgggaaccaggcttaaaaatgaaatcacatacatccttggcaatctaggagactgtgtacatgttcaatgctatgctacctccagggtgattgaagagggaaaatctaagctattagtacctggctgaatgtgggacagaagcatactcttgaactttggtagtaacctccaagtctcgcacacactcaatggaaaagggtaaaaatctaaccagctgaagggacttaagcacaacctttaactaataagtggcctgtgccaaaccaggtatgaactaggttgccaggtgaaagattaaaatcaagaaaaaaaatctgaacaagtacatcagaggctgcataatacaggggaaatggactgcatagagtcagttcagcgaagtcactaaataaacaaccaagcaaacaacaacatcagtgtcatagggaaggggagatcagtgtccagaattgctatattatctaaaatgtccagttgtcaacaaaaattatgaaacatgaagagaaacagggaagtgtgacctctacatgggagcagagggtggggaggaacagcaatagaaactgctcttgaagagattcagatattggatttatcagacaaatacttcaatgcagctgttgtaaacacattcaaagaactaaaggagaccatgtctaaagaattaaagtagagaatattaataatggacagaacctataaaaagaatcaaatggaaattctgaaggtgcaaggtataataactgatatgaaaaaaattttaaagggactcaacagcacattagagttggaagaataaagaataaaaaaacttgaagatagataagttatagattatgcaatttgaagaacagtggaaaagaaaaatgaacagagcttcagagaaatgtggaacgccatgaaatgcaccaacatatgcataatagaagaatagagagaaaatgaagtagaaaaaatatttcaagaaatcatggctaaaaacttcccaaaagttgatgaaaaacattaatgtatacatctaggaagctcagcaaactcaaaataggataaatacggagattcattgccagacacatcatagtgcaaatattgaaagccaaaagcaaagagaaaatgattcatcatgtacaagagaatcccaagaaaattaaagttgatgacttctcatgagaaaaaaatgggaacaagaaggcagcgtgatgacgtattcaaaggactgaatgaaagactgacaaccaagtatcttaaatacaataaaattacctttaggaaataaaggtgaactaaatacattgccagataaataaaagctgaaggaatttgttgccagcagacctgccttacaagaaatactagagagatttttttaggatgaaagcaagcaatatcagacagtaatctgaattcacatgaaaaagcaaagagtgcttataaaagtaactgtgtagttaattaaagagcacaaaacaatagaatatttcttcctctttctattcttaaccaatttaaataacataaagcaatatgtatttgtatataattgcatatatatatattgatttatcgttgtgcttataacatatacaaatgtaaaatatttgacaaaaaatagcacaaaggaggtggatgggaataaagttacattggagtaaggaaatgacgccagatagtaactcagatctacagtctgaaatgacaattaaaaaatggaaaataaaaaggttaatgaaacaaactctgtaaatatgtgcttgctctgctttcttctcttggcttccttggaagatgtaacattgcataaagtaataattataacaatgtattattagattcgtgaatgttatactagaaaatacatgatataaaaagaggaaaaataaagatgggtcaaaggaacaaagaaggcgtgacacttgtagaaaattaaaaaactaaatagcagatgtaaattttatcttatcagtaacagaaaatgtgactggattaagcaatccaatcaaaagacagatatcagattttatatatatctagttgttgtatccattattgaaagtagggcattgaagtctccaactattattgttgaattgtctgtttctctctacagttctgtctgtttttgctttgtgtatttctggggctctgtagttaggtccatatgtgagtgtacttattacatcttcctgatggactttatcattatgaaaggtccctctttatatccagtaacattttttatttaaaagtctatcttgtctgatattagtataaccatgtttgcatgttgaatctttttcaatccttttacttccaacctatctgtatctttgcatctaaagtgtgttttatatatatatatattatatatatatatatatataatatatatatatagattaactacaggtatatatatatatacctaactacagagccccagaaatacacaaagcaaaaacagacagaattgtagagagaaatagacaattcaacaataatagttggagacttcaatgccctactttcaataacggatacaacaactaggaagatcaacaaggaactagaagacttgaagaacattctgaaccaaccagacctgacatacatacagaaaacttcacccagcaacaacatagtatgtattcttctcaaatgcacgtgaaatattctccaggatagacagactgtatgttaggttgtaaaacaaacctcagtgaatttaaaaatattgacaatcatacaaaggatgttctccaatcgcaatataattaaattagaaatcaacaacctaaggaaatttggaaaatgcacaaatatatggaaattaaatgacacgtcttaatttccaaaataaatgggtagaagaaaaaaaatcacattggaaatgtaaaaatatattgaaaatatgaaaattaaaacaaaacatatggaaactatgggttgaagctaaagaaatactcagagggaaaattatatttttagatgcttatattaaaattgaagaaagaagctgggcatggtggctcatacctgtaatcccagcactttgggaggctgagacgggaggatcatttgagcccagcagttcaagaccagcctgggcaacataggaagaccctgtctctacagaaaatacaaaaattagctgggcgtgtatgcctgtagttccagctacttggaaggctgaggtgggaggatcacttgctggtataaatgcaaaatgttacagctgctttggaaaacattccaatagtttcacaaaatgttaaacagaatgccatatgactcagtaatgccacacctaagtttatacccaagaaaacggaaaacgtatctatataaaaacttgtatgctaatgttcatagcagcatcatttatggtagccaaaaagtggatgcaatttaaataactatcaactgatgaatggatataaaatgtggcctattcatacaatggactattatttagctatgaaaaggaatgaaatactgattatgtgctacaacatggatgaaacttgaaaacattgtgttaaatgaaagaagcaagttaaaaatcatatgttttattccatttaggtgaaagaagcgagtttaaaaaagccatatgttttattattccatttatattaaatgcctagaataggcaaatctacagagacagaaagtagagtagtgtcccagtgggggtatggggagtaactgctgatgtgtaggaggtttcttgcggggtggtgcatattttcacaacttagattgtggtgatggttacacaactctgtgagaatactaaaattgttgaattgtataccttaagtgaatttatagatttctatcccagtaaagatgttgaaaaatacatcatctggaaggagtatatatacactattacagggccgtgatttttggtccttattcttgcctatcatagttccttaaacatagtaggaaacatttatgaaatgagtgagtaaaaaatgaaatatattaatttgaatgtatcattctctgtcttggttagtgaaataatacaaaactgatagtggttaattacagaagcctctgagaaagcattttgaaggagcagaaacatggtgtatgtcagaaaatgtaaaatacttaaaggagaaaaccaaaaatacaccatgaattgacagacaatggaggaatatgacaaagggcagaaagaaaataagaggaaactgtgtagttggagaatttctagtatataaaacccataattaatctctactcaatgagtgaatacaagtctggtatgagaattgattcctaaaaggacttgccagactttctggagaagtatagaaccaataagtaaaatctagttattttccctcattcacataatagttctttttttggttgcctcttatgtgaaagttttgttccctcctccccatctagcatggttaattaagctcccttctgtgtaggaacttatacttttatgcttttgtaaggtacctaggacacacacacacacacacacacacacacacacacacacacacacaaagtagtaagtgatgcattttaataagagtgcttgaagtgctataggaattcagaagtagcatttgagttggatttatgcatgcagtgttgggtagaagaagggcactccagtcaaaaggcatccagtttgactgatgtttgtgaagggagtaatgagagataaagctggggccaaattctgtcccagctctgatacttactagccaccttgagaaagttaacttcttcctgagcatccccttaaaacagtggagataataatcccacctgcctcatgtttattgggagaattagatgaggcaatacatgttaagcacttcttacatgatctggtacagagtaagtgctcagtaaatgtttactatgttttggcatggaaaagcttcaatagtgagctaagacatttaagcttttatgttgtggggagcaataaataaagattttgaatagaggagtagcataatcaaagcaatgctttaggaagattagcttgggacagtgatctggaggtaagagaaggggagactggagacaggaggaagccattgcagtagtccaggaaaggtagtgggagcttgaacttgagtattgataatgtataaacctaccgtataaatattagtgacagtttggtgctgttgtaacacaaataggaaacatagggaaaaggagcaggtttgaaggtgaaaatgaaaggttggttttatacatactgagtttgagataccagtgggacctccaggaagaaatgtgtgacaggcagttggaaattcaatactgggggtcagggtttgggagaatatgggagttgttgcccagagattgtagccaagaggttgtataagattacaaaggagaagaaatacagggtcagaagagaagatagttaaggacagaacccttagaggtgggaaaacgaagagaaggcagataatatgactgtaattgcttttcacaaggcttggttgttgctatttagtattatatacttttcctttgtacctgccaactgattgttttactgtcttcttcagtaccacagctgactgggccatcagtagtagaccttatacgtgttcaaagatggatacagttattcttacatagctcctaagtccttttgcttttacctaaggctaacacgacaagatctattaagatggcagatcagttgtatttctgaagaacatatgggcactataagaaactacagtttggtttgtcttaccggtgttctcaaaaaatacagagaaatatgggcaaccttgaggtactatgaggtggcaaatcatatgtctgatgctttctcattgaaaatttgaaagttgattttatcttgaaatgtcttggttatccagaaggaggacagaatagttgtaaggataaaaatggggttcccaccctgctgcatgattaaaaattgcctatggatttctctggtgccagttgtttcattagttcttcaacccctagtgcatacagcagccaaacatggaagatgatttaaggtcatcatcatgggctttcctgcacaactcagggagtgtctgcttgtgcttgagcacgggaattctttgtcacaaggggaaaatgacttgaattggctgattcactttctttgtttctgactaggcccctgtgattcaattaacttttacaagtgaactatgggcaatagccacaatccagtgggctggtgaaagaattgtgtggttctgctgcaatataaaaaaatgtgcataagtctttgatacgggaaggcatttgtgatgctgtaaaattaatgagttggcactgttctctgcatactcttctaggctttttatggcctttttattccattcttgtgttaggggatttggggtatgtgttttttctttgtcttccctcttgacttgcatctttaggatacttctaagtcaggctggtcgcaatcttatttttagaattcttaccaaggtcaacctagtcctattatatccagatgctgcccagtcacacctttcaacttcacctctccgttaataccagtcgcactagtgaaatggttgaggcttgtgggtaaagttgtatccctaacctggacttgtctgtgggtaacatctagagtcagtctgaatatgggaagtttgagttggggctccataggatcagaaaatacttaacttgtactctgacagcttacaatttaatttcctcttcttgcagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggttagggtaatacctcaccactaggaataagagaccatagtaaccaagggagcgggacattggtgccctgattatttaatgttctgaggcctttaaataaaatatgcccctgaactattctgtggtgtgtttcagatagagtaactgtagtaggcttcctgcccattttagggtattgaaaaggcccataagtagaggaatatgtatagtggaatcacaggatgaccatatgaggaacggtttttggcgtgctcttttgtggggtcattgaatttctgtttcttggactgcaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaaggttaattactagggtttagttatcagcttgtgagtgctaatgggaagcatcccttaggacccccacttactggccgtagacaaaggaggaagccttaattcacaggccaccaagaattgagtaattacttcttagaaagctgcagccagtctccctgtgcttggtggcgttgtgctttcttctttctagctaatgaaaacataactgttgagaaatgtggttccattttgaaggggcttcattttattctgttggttaatgacttcatgtcatctcttctcctgccccctcactccttcatacagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaagatcaagtaggcttggatttgaatatcaaatgagagattatgtgaaaatataaggtaatgttatatttctaatttatattaaatttagcattacctctggaagaagaaaagcataaacaaaggcatggaaaaatttggaatgtgaaaaatgtgttcgatagaagtggtgggttaatataaaggggactaaggttatatcatgatctgttcgcctgctttggtattcgcattttaataagggattcttgaaaaacctataaggctcaaattaaaaaatatatttgtcatcaaattaatgggatttcaggtagttagggaagtactttagagtggaatctgatgtccctcagaatatacctacttactcttcaggctagtgctgagtgaggggtaaacttcgtactatcagaaatagtaaaacttattctcttgtaaaaggagacattgtattcatttctttattgtgtttacatagcacatactctccaaagagttcagggtacttttcaaaagacattgaataatgaacacataaaaatataccaacagtaaaaagtaggaagtagaggagaaacaatcaaaggaaggtgagatcaagcagtggcaaaaggattagctagtccagaggaaatgtcttggatattcattctgtttctcctccacagagttacttcagaacacttttccaaattaattttaactccttcgaaagggggctcatagtacatagcccaagtgagactgcagggaatgaggggaggccaaatccaggcttcatcattagaatgagtacttaaagataccccctgcccccttaccttccacctcaccccagctctagcttgccatatgattaattttcatgttagacatttggattatgatagtcaaggccgcagttgtctaaatgtaaatagtaccgagggaagagtagcacattccgacattctctcagtgagacttattcatcagatgggggctgtgagtgggtgagatttcacacagatggatgggagtctgctggaaggaaaaattcagagcattgaaggttctgcctgtgtgagtgtttgttgggtgaatgaggggactgagtaggaaggagggcaggcaatgaggctttaaagggaagaaggtaggaaatttgaactcatctttcctagtgcttactctcagcccattccctggtttgtggacctgaccccacactgctttttccagcaccactgtctgtgtgagtccattcacttcaataccagagccacctctttgtttcctatttactaagaagccataccagcatgagatctccttgatagtgttaaatcccactgtggaaagattgaaaaatatctcccagccttaccagaggttacgatctagtgtggaggcaaaagacattgagaagaaaaaagcaggtgcctcctcctggctctcctgttaggttaacataatcataattcccctttgaaatgtctcccacatttgccctttaacttcctattgccatgataagcatttaggttattacctaaataacttgttacctcatgccttgattatctaaataaattcttagatggcctcccttgcctcctgttctccctcctcgatccgccctactcagtgtcaccaaattttgttttttaacaacttcgtcaggtcatgcctctgcttaaagacttgctagtgttcccaattgcccaccgagtacaatacaaattccctaggatggtgctcaaagccctttgtgatctggcttcagtcatcctttctagagtcatcttgaaacattccggatacaagccacattccatctaaactgaacaattttccagtttctgaacatgcttttaagatttctcccatctccatctttgcaatttcattccctttagctgcaatgctttccctcatcatctttcctttggctcaaatgccaactttttcctgcaaacttctctgattaacccagctagacaaaaaatttctctgtgaacatttaagttttcaaggcttttatcacaaacatccttgtcctgtcttccctattagaaagctctagattcaaatattcagctgcctacttgacatgtacacttaacatgcctcattaaaaataagcagtgatacaccctggggctgttccctttctcccagttttcctcatcttagataatggcacctccacccatccagttgtttaagctagaaacctggaagttatccctaattttcctcttctctcactccctacatccagtctgtcaacaagtctgtcagttctacttccaaagtgtgtcttgactctcctcacttttactacagctaccttagtccaaactgccatgatctcccatgggttattataactcctagctggagtccttgcttctactcttgttcctacagttgtctatagacagtgattttttttttaaagtaatagatcatgtgacccccctgcctgaagcccttaaatgacttctcattgacacttagaataaaatccaaactgcttacagtatcctgcaaggcccctgcctacttatactttgtctcttgcaacccctcttcatataccactttccccctggctcactgtagtcttcctatggacacatgtcgagctcttacttacctcagagactttaccctgctattccctctccccaagcatactttacccatactgctccctccgctagaatgctcccatctccagtgttagcatatagctggctagtccccatccttcaggtcttgttgtgtcacttaatcagacaggcattccctggcagccttttgtctctatctaccctattatgctatcactgtttcccgttttcctcaattcatagcacctcacaatgtatcatgatatatatggtcatttgctttcactcaacaaatatttattgagtactgactatgtgccttgtgatatacagtagtgaacacaatacacatgctccccgtctgcctccctcactagtaagtttcatgaggggaagggccatgcctgtttttgccaaccactgtatcctagagcttatcctagtaccagggatctaggaggtagttagttaatgatgggaactgtgttttgttcatgtcttcatctccctcaggggcctaaaacagtgccttgttcatagaaggggttggataaatacagtatgagtgaggtagatggcaatcctgtacattcaagttggaaaatgaaagactgagataataagtgctataggttataagggacaattagcgtgagctgcagtggcctagtatttctctttaactgatctttggtatgggtaggtagaaaggctaccaaaggagaacaggaatgtgggtactctttactacaaacattctgaatcttatcaaaagaggctccctggcatgcaatttttaaatactgagaactataaaacataaccaggagatgtctgtagagaccagatcttgagaatgagaactaaaaggagaaagaaaacattctgaggaggcgtctgttcactttttctgagtggtgatagtttgtatcaagagaagaaaggagctatccacaaggaaagaacagacagaacaagtttgtaggaaacaagttctgggcactaggaggtcgatacgtgcttgttggatgaactaatgggcagcttaggtagaggcttagaccaggtaccttgtggccccagggaacagaaaatttgcttgcccaggtttagtgattgcagattatctgggctaacaattcagaggcagaggcttaattgcaagctcttcattcccagaggcagactccagatagaatgtctttcagaattctgtatatgaattcaaacccttttctatagttctgtatttggagtgaagctcaggaatgccaggtgtgagctcaggctaagtcaagtgtaatttccttcaaagaatgacttacgctttgtgaaatggacatctctaactcatgacttctattaggcaaaggggggcattaaggaactacactttctgaatcaaaacttagagcacatgtttggataataaattagataattgaaagaagagctgacttagtcttagtatgtgaaagctttagttaccaagtgagacataaatggcattcattttctaatagaaaataaaatctttcagaagaaattttgttacttgcccccatccctaagcccaaagttttgatgtgattcaccagaaattcccaacccaattttagataaaaccgtgcaaatgttttgggtgctttcaacataccaaacaccttccatatatctgtccattgtgccctcaggcaggcaagatgactttagacagaggctcaggaaagtgttccagaaggtctgatcttccagataggccctggaaacctggaaggattggaaagctgaagatgtgtggggagggttttccaggtatagggaagagtaaacaaagtcataagactgggtggggagtgaatacagaaatacccaagagggtttgagagagtggattatccagtgtgaagcataaggaacacaatcaaccaagggctgggaaatgccagcaagaggggctgtgctaaacctgcttaatgaattaggatgaagtagctgttgaaatctctccaattgtccttaaatttggaatgttaaccacagtgtgtagttaccttggattgaccatttctctagcagtgagacctggttaatcatggatttgttccaatccacatggtcacagatgtggatgacagccaccattatcccttccctctccaacttctcaggtctgcctttcccctggcctcccacattttatgagtggaaacccatccaaggtcttcaagatatttgaactttggggaagaatcttgagaagttttggcctgggaaagactattcctttgataacatggattcagatctgtggcagaaaatacactttgttgtctgcccccattccccaaagacacattttggtgtggctttgaccctacctttaggtcaccaatctacttatttattacccatttgttagtacctactgtataccatgaccacactgagaggcagctctcatccacattttatagatgaggaaactgaattgtagagaattgaagtggctttcccaaggccacccagctagagtgcagaggcaaaattcaaacccagattcatctgactccagagcccaaactcactgcctattacaccatactgcctatcttgaaaatgattagtcttgtcttcttccttttaataggaaaatgctaaagccagcccacactaacaggaatttccaaggaagacagtttcacaatcccacacaatgtttaacggccctcatgatcaggaaattgttcacttatataatgaatatccctccaaacaacgtggaaattcatttccccttgactgggtttttcactcacaactgtcacttggcagctttcctgatatccaaacagctatcgagatcctattcttacactgcgggaggtcttggacttgctggcctctgcccatgggtgttctcactggctgctttgaatccccctctccagacagtgctgagttggacaagtctcttggggagtgagaaagtgacacttaagaacatattggtttattattacacacagagaagtaaaattaaccatacaaggtacctccggaattgccaacaggaggatggcaccccctttctcatcctgtctgccttttccttgatttttttttattatacttttaagttttagggtacatgtgcacattgtgcaggttagttacatatgtatacatgtgccatgctggtgcgctacacccactaactcgtcatctagcattaggtatatctcccaatgctatccctcccccctccccccaccccacaacagtccccagagtgtgatgttccccttcctgtgtccatgtgatctcactgttcaattcccacctatgagtgagaatatgcggtgtttggttttttgttcttgtgtagtttactgagaatgatgatttccaatttcatccatgtccctacaaagggacacgtgaaaccccatctctactaaaaatgagtttttgtttaactggcttttctcctgagcagcccacacagaatttggtcaaatatcacagactctgaaaacactggtggagaataggagctactactcaaatgctggcttgtccaccacactattcgcactcgtttggcatctcatttcacatcccattaacctcgctagtatcttttttttttttttttttgagacggaatctcactgtcgcccaggctggaatgcagtggcgcgatctcggctcactgcagactccgtcccccgggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagttctgggattacaggcatgagccaccacgcccggcctagtatcttttttaaagcatgtgagcgttttcagtgttatctccacaaggtcatgagaattttcagatggaaacttcttcaaaactcctgaggaggtgacctgtgaagtggtgaggctgccattctggaggaataggacttcagagaggacgggaaagcagcagctctctcctaaaatggacctgatgatgtgcccttgcatggtggcttcctgctttatcaagctctaagactgctgcttgtctttgggggtgatgaagcccagagcagggaattttaggtgagagttaagaaattcctgagctgcaattcccaggaaagtggtgggctgtggggtgggaggaagtggtcagattatagcctctgcattactgtgcctgataacagcctgttaatattttatcagtgatcacatcacagcatatagtgagccaccacttagggcagaagagagagataacctgctagacttcctgtttgaggttcttttccctcttgagataacagaatttctcatcaaagccgggagccgcttgagcagggagaccagtctgggtgaaagccaggcttcagccagctgaggagaagcacatgcacttcctggcctgggcctctgtgtcccagagtgggctgctgcaggcacgaaagaatcccctgtccgtgggcccagggctgagtgggagggaacagagttggccctgcaaggcctcatcaccttcctttagcactaggctcttctcttgcctgtctcccttctcccacacctgcatttctcctctggtccagagacaaaaggcccctggctacctgaatgggcactgattgtgctgcccccagcaaattccaaagtcttgtgcaagggaaggagatgagggagcagaagctgagccccagggtcactccttcttttagagtcacataagggtcctgtgaggcaaactcagaaggattccagattagctgcacagcatatctctgctacctccttagcaccgcctctacacccgattgctcaatttcccggagtccttccattgcaagaagcagttttcatcatgctttccccaaaagctcatgtagtgccaggccctcatttcatatggattggaatttaaggggacttacaagactatttttatcagcccttgacccctatcttatatcacttttgtcacgtctttcacaggacagcccatatgctgcctcgtaccacagttaggtgtccatgtcttatctcctctagatgagctgtcagttcctacagggtacaaactttaccttgttcactctcatcgccctcaaagccctttgcacatttcctgacacagagtaagagttcagtgagtgtgggctggccagcagatagctgtttgaatggctggacaaaggtctttccgaaagttggagcttgcctttccactaagaagccagtttcagtccttcttcgcccattaatgatcacatagcagtgggtcactagggctccaaggggaagaaaatatgagtcatgttactatcagaggaatgagagaggacagaaacatctctccttgtgcaagggtcagagccatggggctggagcataaacatagtggccttcactatcccctagctctgtggctaatctaaattactttatgagggaaggcaatggggtgagctgaaaagtgtttgccctggacccaggagccgggaatatttctaggaaactacttagagcaaagcctttcttgctcaaccagctggagggaacagttgctctttgttaggtcttccctggcttttctagttgaggatgaacttctgactccttccactgaaacttcccagattaacaaaggtaggaggacccctcaggccagcctccttctaagatgaagggaagctctgtgctctatatccaacaaaggcccttgtattccagtggcagacagggacacgaagcctgcaagagtctgaagagcaatacgtcctcatacaccttctgagaccagaatgctgggctcacgttgctgtgagaagtttctaagcttatgttcaaactctgacactgtgacctgagtgatattactcacatctctgggcctccattttgtctcttgtaaaagacccacttcactggagtatgtggagaatgcagtgaaatcagtggatctgcaagtgctttagcagccagatggtggctcatcagagcccataccagactgctgcccactcagcatagcagagccagcaaggtggttttatcttccaacctccagtggcccccaatcaagggctctggggttcctggtgccagaccagagacatgacttcttgttaagcttttatccagggagcttctctctctccccttatccctgcctgctgccattccctctaaatggacttggatgctgatgttctagcctctgcaccaaagaaggctcacttcagaagtgcaagggtagtgtctgatacaacaggctatgtggtggggccctctagatccaggggctggttaagctgaatcaggtagggccccattattgtcagtattgccacagtgaacacccttatgaatggggctttgttaattcctagtgagtgtagaacagggccaaatcattggcctcccaaactgccacaccttcagagttaggggaattggaactgaggtattgtgttttactcaatgtaagcccggcatccccctggtagagcagctagctgggcccaggctggccagcatagcaggagagggcagttccaggtggtacacttgatgatttcccagattgccctcatgggcgaccaggagagcctgtgtgccctccttgttacctggctggctgtgagttattttcctcaggtagcttggggacctctggaaggctcttctattggctgtgaatagtgtgggattagcagggtcctattttgggagtcaggagactgagggaactaacactatctttgtgtccctgggaaaatctatttacttgtgtgggctttagtttccccatctgccaaatgcagatgatcagatccattttaccttcctcatgatagtggttcagagaatggaaggaataaatacatcatcgtttagtaaataactgaaaacaattgttatgaaaaggaaagagccctgggcaagttgaagaggttggagttgccttggggaggagattgtcatgctttctaattatttctagtaaggtctagaattgtctatctaccctgtggaaagaaatgccagtttccaccctcccctccccttagccgaaatccctcgagtttcacttgcccgttctgggccccttttaatcagtaacacagttactcaatcaacaagtgtttattgatcacctactgtgtgcctggcactgttacagatagtctgggggatacagagaggtctaggatatggcccccacccaccgaagggtttacaatatacttgtgagatcggacacacacacacaaataacgatcaatcaaaaattgtgaatgctaagcatcaagaagcaatttatacattgagggttgggggagggaggggtaggagagggatggagtgatcagagaaggctcaatgaaggaggtgacgctgaggaagttctccaagcctgaggaggacttggctaaggggagacggccttccaggttgggagagcagctggaacatggcaagaaggtggacatgtgaaaggcatgttacagacaacagatgggccctctctgctgacaatgaggttcgaggaggtgtgctggaatttttcagaagccagtcatgcctagactggtgagggaaaatacctttggtgtatgacccctcactcccactccagggtaaagggaacattttcggaccttagaggtggaactgtcttcctgggaaccattctccactcccacctcagctgcaatcccaggcagcagtgcagctatcactcagatcatggacacagcaccgtgggcatggatatgccatgctggagcccttagatgccctctagccactctggagcatcttccgatggacagtgggggaatctgaaggggctcgcttggtgctatggtctttcagaggctctgtagtgctctgtgggtggaccctgggggggcctgatctcatttgagctgattttccattacgcctgaagagtttctagggggctgcctctcactggcagagtagaaacacccactggagccaccacacacatccacctggcttcttagacaccgtcaaggaatggtgtcttcctcagtaccccacagctcccacactgtcatcccccagccaagggccatccctagaaaaactggtttactgttcctaaggaaaccattgtctatagcccttagccttgtggtttaggcaagaggccaggtcaggtgccctagagtgaggcaggggcttcagccaaagttgtgatcgcagcttctgaggcagttcctcagtggagtcagagtccgctgccacctgagctttccaccagatcttctttcctttccttgtgctttcctcaagctgcaggcttgatcccagcccacaaatatgagagaattctggaaagtgccctgagaaatgggttctgggtttttttttcatttttatttttttaaatgtcccaggctgccttcctgtcctcccatcctgcatcctgctttctgttccctggataccgtaggatggttttatttcagttcatgcacaaattagtctggacactgtggagtcataacaagagtgggatggaggttccagggccaatcagtttctttggagggaagcttgagaagtaggttagagcaatgcccacaaaagccactgcttctccttcccatccccagcaatgagctaagagccaacctcagccagagagagggtctttgatcacagagggtcagtcagtgggatgtgattagtgggtttggggatggagtcccaggtaaaccagagggcaaagggatcctctgagtcctggcttaagggaatggggtttcaagttgagggttggggacttagggcaggggagcagcaaggtgaggaaaacagaaaggctggcatggcgagcatccttggcaattcaacctgcatgctgttacactagcccccatttctgcctttgctcaatccaatggccaaagtcagtctatcctcagcagcaccttctgacacgatccagtggtagtgtccctcacctgtggccctcggggtgctgtccactgtttttcacagacccagccaccccccagctctggcccctggttcttcacacataccctgtcaggctgtaggaattgaactcactcttgactttgggaggttgaccaggccttggagagctccttgtggcaagaggttgggcttggtaggcatcgtagtagttggagcgatttctctgggatgagcaggaaaagcagaggatgattccagctatcagggagaacagggaagaaataatgcccaagtaaagagcctctccaatctcaaatttcatgctgtcaggcaccagtggtgagtagaagtcccgtaggatcccatgaagattccaggcaacaggaatgaatcccaggaggcctccaaggatgaaaaagactccacctgctaccgccactctgtctttggctcgggattcctggcagaagactgtgcatctcatgcccaccacagagataatgcaggccagggaggagattgcactggatgtcaccatcatggcctgggcagcctggatgtcagcgggcaggcccagaagggtgctatagatgtcacactgggtgatgcctgtgctgtgtgtggcacattccatccagaggcccttggagaagccaactgctgtcacaatgctggcaccgacataagaacttgttttccagctggggagcagcatggcaaccagtgtgcccaaaagccccagaaggcctaggatgtagcccacaagttggaggccaagagaggccatggcagacctctcagtagaagcgtcttcagggactgctcccttgtcttcaggctgaagctcttgctccttgaacacctctaatccctcatttcagagtctctctgccaggctgacttctctcctccttacaagtgtctgtgggtggccacaagcagcctcaagaaggcatctagaagacctaaaaaaaatccataaaccagattaaatattgaccagaagcttatgagaaaccagaaaacgctggatgccttttgacctttgttatctttagaaataacacatgagaaaggaaaaaaaaaacaactttgaacgtggagccaaaatgtcatcgcctcctgcgtaggcacatgccttaggttggcagctggacaaagccaggagccagacaggtggctgctttccgggaaggtgatgatggcagtggtggttgtggtggctgtgttaactcaagtgctagtctccaaggcctgctgtttaatacattgccaagcaacagtgccatagggcccctcaattgcagactgaggccaaactgcagactacatcaggaggaacagatcctagaatgtagtcttggactccagtttgttagaggcctcttgaatctccaggggcctagagagtagtggcctagccctggatcattctgcccatggtgaaaatctactccagggtagatgggggtgggcagcaaagccttctgtccatactctgagagttcagatcctcccagccatgcccaaatccccctctgcagcctagtctaaggcctcctgcatgtataacatgcccagacatttcctgtccagtctcctaatagatgctcccatcatcagcctcttggatgatgagggagcactctggaacaagggttccaggactgagagggggccctgaaattccctgggccatctgttaggggggacaagagtctgccacagaggaaagggaaactgctctagaatatagggctttgcatgaggcaggtatctgagtcaatgctttggaatctcagagccatataagattttgccgtgttcaaggagccctcggtgttgccaagattcaggacactaagggtcaagggcacacctccccattctctacaagaccctctgatccactaatttttctttctttctttttgagacaggttctcactttggcacccaggctggagtgcagtggcatgatctcggctcattgcagcctcgacctcctgggctcaagtgatcctcctgcctcagccccacaagtagctgggactacaggagcgcatcaccacacctggctagtttgtgtgtgtgtgtgtgtgtgtgtgtgtgtgtgtgtgtgtgatcctcctgcctcagccccacaagtagctgggactacaggagcgcatcaccacacctggctagttgtgtgtgtgtgtgtgtgtgtgtgtgtgtgtgtgtgtgtgatcctcctgcctcagccccacaagtagctgggactacaggagcgcatcaccacacctggctagttgtgtgtgtgtgtgtgtattttttgtagagaccaggttttgccatgttgcccacactggtcttgaactcctaagctcaagtgatccacctgcctcagcctcccaaagtgctaggattacaggcatgagccaccgtgcccgaactaacccactaatttttcaacccaccacaatctggctattccattttagccttcttcaagatttctctttccctactcatctcttaaatgtgagtattcctcagaagtccatccttttctcaattaacactctgtccctgagcaaactcatcttgcccccataacttaatctactacccatccactgaccctcccaaatctgaatttccaggatagacccttctgagcttcaagactggcagagcaatcacctagtcagaatctccacagggaaatctcatagacatctcgaatttgacatgtccaaaagtgaactcatcacatcccccatgcagctttccccaaacagttcttccctgtgttccctgtgttcactgaatgatacctctatccatccacttgtgccagaccaaaatccggaaagtgatctttagcacctttcttctacttacctcctgcatcctatagtccctatgtcccaccagttctaccttatgaatatacctcaaatccatggttcctttctctccatttccactgctacttccctagttcagtttcaccattctttttttgagaccgaattttgcttttgttgcccagcctggagtggggtggcgtgatcttagctcactgcaatctccacctcccaggttcaagtgattcttgtgcctcagcttcctgagtagctgggactacaggtgcacgccaccacgcccagctaattttgtatttttagtagagacagggttttgccatgctggccaggctgatctccaactcctgactgcaagtgatccgcccacctcagcctcccaaaatgctgggattacaggtgtgagccaccatgcacgacctcatcattctctttcacctggattatagcaacagctttctaacttgtctttctcccaattcattctccacatcattgccaaggtgatctttcaacacattaatctgatcgagtcactactctacataaagcattccagtggctccccatttgctaaaaagtaaagtccaaacttgcttggtttaccccatgacctctcaagcttcatctcttgccatttccctcctcatagtctgtactattgtggaattaaattacttccagttcttcaatcatgccatgtggtcttttgctcccaaatagaaatagaacagaatattctatgcagagtgttatgtattcttcttcctctgtttagtgccttctcatcttttaggattcagcacagatgtctcttactctagcctgggtcaagtacccctcctgtctattcttacagtatcttgtgtttacttccatcatagtaataataataatagcaacacttatgtagtgtttcttatgggaccattataagcactttttacatgctaacttatttagtcgtcacaggtttttttgtggtaggcactaataatccctattgtatagatgaagaaactgaggcagagatagtacattttgcattatgttgcaatttcctgtttaaaccctcattcttccctattagcctgtgagctacttgagggcaagactatatcttatgtatctctgtatctcatgtgccttacatactgctttatccagagcagcaattcaaaaactgtcttcttaataaatgaatgaagttggcaaagaggtttgaggggctccatatgactaaaatatagggactttccaaatgagtcaataacgcttcagtgtaagggtcattgaagtgctgcccaacgttgggaaagaagaaagagagagatgggggatcagaggaagaaagaggtaaggggggagagagagacagcagagcttcactatgtatatatataatgtatattatatatatttataatatatatgcatttgtggaatattttgtctcctcaaccaaattctaaacaatttaagggtgaaaaaatatatattaaatgtctatcatgcttccacagcattgggcacatgattgatagtcaatacgattcatcagcattggaaacaccaatgccagtgttgatgcaaagcagtgcagagcaggagccgataaacatttgatgaagggagagaaacatagtttgaatctcacctctgtcactcattagcaagtctttcttgacattggtttcttattgctaaccttggcacaattgtacctgtcctgatcatgactatgtatctcattgaggccttcagtgctgcttggaaatccttctacttctccctggtaagcacccttctgatgactgcttcaaacatttactactactttttgagctccctactctacctcctccctgtgcagctattactcctatcttgatcattctctttgcagccaagatccttaaacaagccattcattattgatgtctccacttcttcaccctcccactcactgctcagccctctgcagtctggcttccaccattagccctccactgaaaatattctcaccaaagttatcaactcttttcttgatccaaaattcaatgatcatatctctgtcatctcaccttgtctctctccttcataaaactatcttctcccttgttttctgtaacaccactccattttaactacttctcaaaatgattcttctagttttcccttataagttcctcttcttctgctcactctttaagtctaactatccatctctgcccctctagcctcctcagggtttcatctcgacttctagatggctcttcttatccttcacattcttcatgggttatctcatcctctctgtctccatgccagtgactcctgaattcatatctctgccacagatttctctcctgaactcaagatttgtgtagttaactattacttggaatggccctacctgaatgttttaatggcctcaaattcaacatttgcaaagctggaatcatctgccctttttgctccccatgcccaaactgctcctcatgcagtgttccttacctcagtggggctgtcactgagttaataacccaagccagtcatccttgctttttcacctcttgttgacatataattaattataatgtaccatcaggtctgccttcaaaaatagactgtgaatccatctacttctttctgtcgccactgccctaaaccatagttcagactatgcaaccatcgtttcttgtctatttgaaaatctcatagacacctcaaattgatctctctaattccacttctgccccaatcctgcaataatgaattacctacccagtagtcaaagatctttgtaaagttgaaatcaaattgtgactttcacctcacgctttgccatgcttaaaaatcttcaggagctcagccgggtgcggtggcttacgcctataatcccagcactttgggaggccgaggcgggcagatcacgaggtcaggagtttgagaccagcctggccaacatagtgaaaccccgtctctacgaaaaatacaaaaattagttgggcgtggtggcatgtgcctgtaatcccagctactagggaggctgaggcaggagaatcgctggaaccgggaggtggaggttgcagtgagccgagattgtgccactgcactccagcctgagcgatagagcaaaactttgtctcaaaaaaaaaaaaaaaaaaaaatcttcagagctcttaagtatttcaggatgaagttcaaacttgctagcccaggaaaccaagaaagccctccattatttcaccccggcttttcttcacagcctcatctcacaccattaacctccaacctcatgctttatgctcctatacatacacatatgatccagccaaacctaagcacttgaatttctctgactgcctttctctctgtctccaagcccgtaagcatgctattctaccatccaccatttgcttggataattgcaaatcatctttgaggatgcatccttgccttgaaaccatccttgggccctccctgctcctcacccaggctgggttcaatacttttcctttcttcctcctatttgtatctgagctttcagtgagaattggtgagataccttgaggttttcaaggggaagacctactgcttcccagaggagcagctcctgcttcagccttcctgggatggcagctgaagagtcaagcttgagtttcccaagggaatcaacagtgtccccaagaggaaagcctctccccagagcctgtcctaagtagtagtaagtaggcaagtgttttggggtgagggagagggcagagtcaagaaaatgccattactgaggcttggaatctctagagtctgacttggcatagcagcatgcccaggcaggaggaagaacaagttattggagcttattcaagtgatagaaatggccccatggagggggggttcagctttccaccagagttaggaagaccagctaaatggcgaatggttgggtggtgagacaggctggattcagccaggtttttgtttgtctgatgagcagtagaggtgagggcagacagggtcctggtgttagaatcaaaagatctagcttcttgttgtgtcagttctgcctagaacctgctgaggaagtcctatagcttctctaggccctagtttgtcatctccaagatttttagtctcaaataaaggcatggggacaggaagccactttgacaaatatagaagactgaagagctgttattagaagcagccagttttaatagaagcctctctttgagggatcctcctagaagtcaagtactggctgcgttggaggtacagaggactctaggccttgtcagctgaatttgtcttctgggcatagggccaacatactccatggcccaaggactgggcaagaaagtttaacttaggatccttacttaatcttccctagtggggagattggagctgcaggagaggattaggagggtcaagattgaccgcagctcctgacttaaccccttctcacctaggtactttccctgctattctccccatctcttgctccaagagtcttgtgcatggtactctttctttggcagtaccctcctaagactacatgggacagggcacttggggttcccaggctcaaggaaggaactgatgtggccttctgggggtgatgatggccaccacagccctcttctgtcagtcagcctcatttctatatcccttgatctcactgcccctcataagaatctgagacacttgcccccttctctgaaactcacttccagctgccaagggcactagtaggtggcaaagccattcccttgaggccctactttcttgaaagtttgtccttagagcagttcatctttccttctacatcaattgattgatggcagttcagagaattgcaactggattgagagattttcttattgtttgaaaaagaagttgatttttgtcctgatcatcaaagtaaagcattctcactttagaacactggaaaacacagaaaggcagaatttagaaaacaaaaatcgcctacgatctccccggccataagtgctgtgaatgttttggttccaactgcattttcaaagagggcacttgaagagagtaatacctcagtcgaaagaaggaatttctaatgacagacttgcagaccagtgagggagagtccttgaaggacctcatggggaaactttatgacttcacttaggaacccaccttctgctacctccctgagccttcatgccaaggagggcactggagctggctgtgagggagtgccccttctgccactcctcagtcccctacacttaggcagaggggtaaactgtggctcccttcctccaatttttatcccagtccttttaagcccccaaaccagaaaatatctgatttggagagtgctttctctggtcctgaagttttaaagatttgaacctttgtgatagctttgagggaacaaataccaccaacccaaatgccaccggagtttcccctcccatacccttcactcagaaacccaaggtggcccagcctggctccaccatggggtgaatggatagtgactaggaaggaagagtgcccacctcggtgaatttaaaaggcagcaactatatcaggatggagatacttacagggcagttctttgcagagccttggagggggagatgcccctggagagggagaaagggatcctgagggaggggagcgaagtacaaggggccacgggctgaggtgataaaggatttctaatcgttaaccacagctttgcaaaatccatctgcaaatctgagccgtgggtcagagacttattacagatcagaattaaacccctggaggctgggaaagattgaggcactttagaaaaaaaaaaaaaaaggtttggtgggttttctgtgtgtgtttttttttttctgtcaaaaactccactccagctgggcttttgtgtggtgacctctgtgaacccaggagaggccttgtggggagggggatttggcccaagaaggaattcagaacattccagctttgagggtggtgagaggagggggctctgtcccaccaattaggtgtccctggctagcagccctgaagcccagcagggagtaagctgcataaacacagccctggtgagccagtgcccaagcagccctgcatggcctgcagctccatagacttttctactcagcttgattctctggcaggccctcagccctaccccacccctaaggttggtcccaaggctcaagggcaaacatgggtactgtaggttcagactctgagttcaaagagcaggtcctacaaggtggaactgagtaggccagcataaggacagggctctcctttttaccacacatggcagtgccatgcactatgtcatttaagcctctcaaaagtgctgtgaaggccgtgtgcagtggctcacgcctgtaatcccagcactttgggaggccgaggcgggtggatcacctgaggtcaggagttcgaaaacagcctggccaacgcggttaaaccttgtctctactaaaaatacaaaaattagctggatgtggtggtgcgcacctgtagtcccagctacacgggaagctgaggcaggagaatcacttggacccaggaggcggaggttgcaatgagccgagatcataccactgcactccagcctgggtgacagagtgagactccatctcaaaaaagcaaagcaaacaaacaaaaacccaaacaacaacagaaataaaaccaaaccaaaacaaacaaacaaaaaaacatgctgtggagtagtagagcgcagtgactggctttactctcccaacgcaaaaaagctttctagttttttctaagtagaaaaatactagatgctattgaaaagaattcagaaaatgaattataaagaagaaaatagaggtcctcataatgccaccagccagaaataatcattgctaacattttgatgtattgtagaagatatcgatgggatttgttttataaaattgaatcacactatacctacagtttatgtaaccttacatcatttgtaaataacatatcgtggacctatttccatgtcaattaaaacacagaactacatcattctgtcatggctgcactgcattctatcatataaaatatgatttatttaatcgtaaactactagacgttttgttattttcattttcactataacccagcatctttgcacataatactgacaaagtcttaagaatagaattgctaggtgaaagagtgtgcatgttttaaaggccaatacaacatgttacaaaaataagacagccattactatttccagatgaggaaacctcggcccaatgagatgaaaagagttgcccaacatcccaagttgagcagtaatagttagacttggaatctaggtctgtagatatctagcttggcaaactttgcagtgtacaacaccaactccctcccaaggattcccatgtacaaatgataaggccacggttcattgaacacttgctaggtgccaggcactgtgctgaggtgtttcctatccatggtctcactgtgctagtacagagcaaggcctgggtaccaaacctggccacctctagagcttgcctcatagtcattatgcttgactctatttttcaagtcatatcaaagcaaacagtcggatttgttgcctagggtgaactcagtgaagcaaaccagaaatcatcctccttcccaaggcggcccatccctaccttgcaggtacaaatggggcactgatcccctggcagtgctcctgagcaagggtctctccagggcactccctcttggcaggctgggacacgctaaaagggcagccatgcctgagctcaggcctggggagtctttgggcatgaaagcaagcaaggctgaaggggtgggagggataccaggctaatcctctaaccaactatgtgacctcaggcaagcctctccattttcttttcccaggcttcacccagccgaattcccaaggctgggtgaatgaatgtgaatgcattttgacaagtagaaaatgctgattgaatgcagaatgtagtagaggggcaccttatcagttcatagtgactgtgcaattgaggataggaaaaggcagaatcttaggggcaggtgccagggcggatgaggagactgtgttggcaggatgtggtttccagattggcaatcattcaaggactgggttctaacactgtgtttccttcaggtcggcattgtcagatcctggtggaatcatgccaaatactatgactcctcagtgttgagcctaggaggttctttagtaatccttctgccaagacccctgctgagatccaaagagcttagatgggtgcgggaatggagagggggctgaaagaacaggaaagaatagcagtctgagaaaagcagcatttagttcaggagacaagtgagtagggagagaataaagggagggaaataagagtatgggaagaggtggtttgggggaagagaaaaggagaagagagaaaaagggtctttgaggaagaaaatcaaagagagctctgtagaaagcaaggtcttgaagggcagggaggaaatgatgctatgaaaagaggagtctagaaggagaagtaagagactctaaggaagagggtgtagggatggactctgggagaaggagttagggtctagggcagagagagacttagagacatttcaccctcactgttccaccaaaagaagttcttgtcacagttaccaatgaccgcatgtcaccaaatccaatggccactttttagtccttaatttccatgacctctatgcaacattcaatgcccttgataaccttgtcttccttgaaatactttctcctcttggcctctgtgataacaacactcctctggtttccctcttatctttctgggtacttcttcattggtacctctgcctctgccagacccttaaatatgggcacttctcaggagcctgacctaagtcctcgttcctcactctgcattcccattctgggaagtctcatttatcctctgtggtttcagttatcctctatcatctgacgacttccaaatcatcattttcagcccagacttctctgggcttcagacctttatatactggcatctccatttggatagctgaaagttgtctcaaatgcaacatgtccagggtcttgctctgttgcctggactggaatgcaagtggcatgatcacagctcacaataaccttgaactcctggactgaagggatcctcctgccttagccttccaagtagctgagactacaagcatgtgccgccacgcccagctaatttttataatttttttgtagagatggggtctcactatattgcacaggttagtctcaaactcctaggctcaagccagcctcctgcttcagcccctcaaagcgctgggattacaggtgtgagccactatgcccagcctcaaaattgtatccttgatttccctttgaactgaaatcagtcctccttcagtcttctccctttgagaaagccaattgtttaagccagaaacctcagagttagccttaattccactttctctgaccctcattgtatcagacctgtaaatctttcccattctacctccaaaatttagcttttttgtccatctgctggtttcgacttccactccccttagcatcatctctcaccgggatgcaatacccttctgattttcctatttctccttttggctttctacagtccattctccacatagtagtatgatttggcccctacctagctctccaaactggttttgtactactctcctcactccccactctcccgactggcttcctttcagtttctcaagcctacaatgctctcccttccctctaggcctttacaagtcctgttccttctgcctggaactctttgtggaccctggccctactccaccttcagctggttttgtctggaaaactccttatcctttagggctcagcttaacggttgcttccctgattcctggggtctcttggttggatattcctcctctatgctcccaaagcatcttgttatccccccaccaattgtcttgggttgtatttgttgttgctactcctgcataggactgtgaatgcctgaagggtttggcttttttttttttttcttaattcaacttttatttcaggttcaggggtatatgtgcaggtttgttatataggtaaacatgtcatgggggtttgttgtgcacattgggtttggctttcaattgttattttcatcactattctagtctaatacatagtaggtgcaccattgaattgatggaatcagactgagaagagattgtggtaagaagggaaacactagatgggtctgggaagaaaggggtccaggagaagaggaaggagagacaaaatgattatgtaagagaaaggtgggtgaagaagagaagttctgggaggggaggcaggagaagggctcatgaagacatgtctgggaggaaagagagaataaaggtttgagaggcaatggataagcagatctaggaggagaaatgttgagcaagggcttcctaagcactaatgcacagacttaagaagaaaggaagggagtggtagaggatcaccaataggagaaaactaaggccaatgtagcaagatttgtaaattatttaaagcttattcaatttaaaagactacttgtaattccggacttattctttgaatagttggtattaaggtttcttttgtaaaataagaggtggtagtatttttcaatgcccttaattaacaaaattaaaagtttgaaaaccatatgttgattctccctcattttaaaaaattttgtaattccactggtccacaaaaatcccaattgaggagagctctgggaagagcacattctgtcaatgggtctcaacattttggtctcaggaccactttacattcttatttaggaaatgacctaaatgtctttcaactagtgaacgaataaactggtacatctgtgtaatggaatactacttcacaatcaaaaggaatgtactattgatacacacagctacatgggtgaagctcaaatgtattatgctgaatgaaagaagccagactcaaaaagctgcttactgttatgttctatttatatgacattcttgaaatgacactacttagggatggataatagattagtggttgccaggagttggggtagtggaaggggtttactacaatggagtggcataaggaaattatttggggtgttgaaactcttaattgttgttacataattctatgcatttgtcaaaattcatggagctgcacacccaaaagagtgaattttatacatccctccacattttgtcattcagcaccttaatatctatgcaaatttaaaaataaacaaataaaagatattagttaacaaattattgaggactccaaagggcttttatttgtctaacctccaaagggttatatctattgacattgaacatatttataattaaaacttacattttaactatttatgtattactttaaaataaaaattataaacctattacattataacataaataatatatatttatgacaattatagttttcaaaacaaaaaaatggcaagaaagtggcattatattcaatatttgcaaatctctttaatgtctggctgagcacaaggcagctggattctcatatctgctcttgcactccagctgttgcaatatgtggtttttggttgaagtgtgtgaagaaaatccagccccacaaagatagggaggtagagaaggggggtatttaatagtccttttaggcagaattctaagaatgacccccaaatgtccctcacatgcctataaatttcttctcttttgggagtgtttctgatgagatatcactcccatgtttgtgttagttatatggcaaagggaaattatcaaggttgtactcacctaatcacaggaatcctttaaaagagggtttgtggccgggtgcggtggctcacacctgtaatcctagcactttgggaggccgaggtgggtgaatcacctgagctcaggagtttgagactaccctgggcaacatggcaaaacccactttattaaaaatgcaaaaattagccgggcgtggtggtgtgtgcctgtaatcccagctgcttgggagcctgaggcaggagaatcacttgagcccgggaggtggaggttgcagtgggccgagattgcaccactgcactccaacctgggccacagagcgagaccctgtctcaaaaaaaaaaaaaaaaaaaaaagttttctagtggtggaaaaggaagtcggaagtgagagagatgcaaacttgactatgccgttgatggtttccaaatggagagagctgcgtaagaaggagtgtaggtagcctctaggagccataagcagcctctggatgacagtcagcaagtcaggggggcctcagacccacaccctgaaggacctggattctgctaacaacctgagtaaacttggaaggggacttttccccagagcctccagataagagcccggctcagctaaccacttcatctcagccttgtgagaccctaagcagggaactcaggtgaacacacctggatttctaacctatataactgcgagatgataaatgggcatcgtactaagttgttaagtttgtggtaatttgttatggcagcaatacaaaactaataaatggtgtggggattcttcttgataactacacctaaacttcacaagtggttgtttcttaatgtttctttgcaatgttgaatctgaaactaaaccgtatcggtgaaccttttgtactctgttacattaaaatctactggtcagccaggcaccgtggctcacacctgtaatcccagcactttgggaggctgaggtgggtggattacttgaggtaaggagttcaaaaccagcctggccaatatggcaaaacactgtctgtagaaaaaatacaaaaattagccaggcttggtggtgtatgcctgtagtcccagctacttgggaggttgaggcatggaaattgcttgaacctgggaggtggaggttgcagtgagccaagattgtgccactgtgctccagtctgggcaacagagtgagattctgtctcaaaaaaaaaaaatcaattgcactttgaatggatctgttatccatgcatgattttgtaacatcatgcattagtcatctggaaaatatcggtccacccacttatgcagatcttcccattgctgactcgctttttgattctacaatattaaaaaatcacattcattagtatccctactaatcttattagaaagctctttaggatattgagaagctctcaagctcacagtggctgatacaggttttccaaaattgtgctttttacttgaaagcgtaacttttatcattgacaacaaatagtaacagttgttttccttgaggtgacaggatcattttgtccatttttaacaaaatacttgccaagcacccaagtttgaataaccacaatttatctgtcaatcattcaagtaaaaaaaaaaataaagtgctccccagcactttgggaggctgaggcaggtggaatgcttgagcccaggagtttgagaccagcctgggcaacatagcgacactgtgtctctgctaaaaaaataaaacaattagctgggcatggtggcgcaagcctatagtcccagctacttgggaggctgaggtgggaagatcgcttgaggctgagagatcgaggctgcagtgagccatgatggcaccactgcacttcagcctgcatgacagagccagactctgtctgaaaaaaaaaaaaaaaaaaaaaaagagttccataaaaaattcgctagtttagcttgcaagtcaattgtgcaagtgcttttcctcatgacaattgcacttcagtatgcagaagtgctttatatatccatatatacttcctatgcccagccccatgaaagtagttttgactgaacctcctgaattttaggggctccctgggtctttggaccacatttttagggctgctggtctaggctgaggctggaagagggagggaagaggtctgggaaagagtggagatgaaattttaattatgcttagaaatgtcctgtcagtagaggagacagctgggcatgaagaggaggagaggattcctaggttccttcccaaaggacctctgctgttgttgtgccctttcctactcctgacctgccttgttcatgagctgtcccagccaagtcaacagcgaccctctgtaactactcgtatcctgggatcttgggtgctctgtcttagaaggccccaatatgaacagagaatcccaccctggcccatgcacctgtcatagctgtctgccaccctaccgtagagccccaaggctacttgctagactaaatctattagtcttctcagaccaactacctgtgtcaacatcattccattcacatgaaatgaacgcctgccatgtccccagtcctgtgccaggtgctgatgggagcgaggagacaagattaagccacagcacctcgatagaaaggcttgcttcttatccaaaaaagtgactgaaaagagggctggcacccctacatgggggaaaagctcaaatgagaggcctgcagagggacgcagatgttagcgtggcttggaggcttcctgcagtcagtgtggattcaaggaggacctggaagggagggcagaatttgtgtcatggggaagagtggtgttctagtcttggcaggggtttggggggtggagatggtcatgtgcagggacactgtagtaacaagcctgctggaagtaagggggagagcagggtggagtcagaggtgaggcttgaaggaacagggaaaacatgtaaatgcctcttattcccatcactcatgagctgccattgcgggtgtctgagcaggatggaagctatgttctgggaagccaaatctggcccagtatgcaaaaacacctgaaagtatgtgggacagaaaaggaacaccagtttccatacagtatttcatttcatcctcactccagtcctgggagatgagtactattgttttcatccccaggaaattgaggctcagagattggttcacttacccaacatcacctgcatggtaaaagattgaggaaggcttccaacctaggcctgcttctaaagcctgtgctctgaatagccacaatgtatgcaatgatggaggggcaaaaggaacaatcataatagtcaccatttactgagtgctaactacatgtcaggttttaagcaaaatccatgcactatttctttcagtcttcactgcaactctgtgaagtaggaaccattatttttcccccacacccaagtctagctatagcgcccaagctttttccacgttaagatcgactgcaaaagtacaggcattagacaagaagggcctgagttagagtggcagacaaacctctcaatagcttcttgagcctgggtaaattgcttaatctctccatgcctcagttttctgctgacctttacttttatggctttttttttttgatggagtttcactctatctgcccaggctggagtgtagtggtgcaatctaattttactgcaacctctacctcctggggttcaagcgattctcctgcttcagcctcccgagtaaccaggattacaggtgccccaagccaccacacccagctaatttttgtattgttagtagagacagtgtttcaccatgttgaccgggagggtcttgaactcctgacctcaggtgatctgcccacctcgggcagatcacccaaagtgctgggattacaggcatgagccactgcgcccagtctctgctcacctttaaatggcagcaataatagtaactacctcataagatttttgtgaggagtcaataataaaacaataaagcacttagcacggtgcctggcacacagtaagcagtcaatagatgtgagctatttttcttgtcattgtttttgttagtttctcaggatccacatcccaggaagatagctgccactagttactagtatcgtttgcttacttagccaggatcatcaggacaccaagactaaaaggacaagaggaaagaccgcactactgagaattcagcatcgcttcatcttcccaaggtctcaggccaggctgggaaagggggctgtctcagagaagagaggatgaaaaggctggcccaaggagccaggggaggagctggatggaaggacaggacggagaaggaaaggagcccagctgggagtgacgtttccaaacacctccctcctgcccaccttcttcctcagagctttgtttttctaggcttctgcagtccaaatgaggagcaaatggggagctgcgagaggttctgccaagagagcccgcaccacatgggccacagccctggctcaaatggtggaccaagcagcagagggtgtaggaagagagctgacccaggaacaaactgttctccagaggggacccccgtcccaggaacccaagggactgcatataagagttggcacatttgggacatttggacttgagggcagaggccccaggcaccatttgctatttatgatttggaggcaggcctgggttggggagagaaacttctcctttgctcctctttcagagcagaccctgtattacttcgggcctccactgggcaccctcactggatgtttaggcctcctgccctcaaccccaggggctccggcttgcaagacagaggccagagggaaagaggaagagctcctttctggagaggagcgcagaacttgttgctggaaatttcaacctggcattcaacgttctcctccctctgttgcccgctggcctaggctctcactgttcccaagacagcccactctccccactgctccccagtggcaggatagggctgggcagtggttaggagcacagagactccccgagttcaaatcccaatcttgtcacttttagctctgtgaccctgggtaagttccccagtctcatctttaaaatgcagcttttaatagtatcttcctcactgggttgtttgtgagacttgaattaattcacgcagagtgcttagaataatgcctggcgtataaatgtttaacaaatgttctctactcttattatccacctctgtgccacttttctctgccagaattacatttccaccttctctcagcctccttaaacccagtccaactcaatctcctcctcctccatgaaatctttgggcagtatccagtctcctgacctctgttacacccggcaatgagaccagaaccattttgagagcaaaggacaatgacatgagcagcactaactaaatgaatcacagaataacatctgcgctaatctccttagtgctatcaaactttttgactgtgacccacagtaagaaatatattttacagcatggcccagtccatgcatttggtatcagtgtattcatttgatacacaatgcatttgtatataaacattgttatagagtatgaaaaaaaatagccatgggtgttgggacacacctgtggtcccagctacttgggaagctgaggtggaaggatcgcttgagcctaggaagtcaaggctgcagtgagctgtgatcgtgccactgcattctagcctgggcgacagggtgagaccctgtctaaaaagaaacaaaaaaaacaacaacaaaaaaaaaaaaaaagaaaagaaaagaaagaaaaaaaatacactgtcccaagaatgaccctgagccttccctccagaggccctaaaccctgaaaagattacaggtgaatggcgtgtttgcaggatggagatagagttgagggaggctgcaatggatggtgtgtggaagcccttctgaggcagaagaccggagagcaggctgagctcagatgtcaaaggacttcaactgccacacgaaggagtttggacattttctatagacactggaagtttttaaggagaggaagaccatacttggctatgtgttttagaaaaatctctggggcagctgtgaggagaatggattggaaaggctacctcacagacagggaaaactatgaagaagctctgttgagcatccaggtgagagaggacagatgaggccataatttaagaaacaactgggagagtggaagagtggagaacatggaggagacaaaagtcagaaatggtaaagaccaaaatcagcagccgaagttttgagcttgagtaactgggtcaatataatgctggtttccaaggtaggtacaaaggagatttgtccggcaagaaaacagttcagttttggaataagtttgagatacccattggaaaaatttcagtgggaaacataactctcattctttcattcattcaataaacatttatgggactgacatagataaactaatgttttattttgccagagtagaaacattaaagaaataaagtaacttccatcattgccataatttcaaagaacattttactaccaaaaagtaggaacagcataatctcagaacgaaggagagtcctttattattattattattattattattattattattattattattattttgagacggagtctcgctctgttttccaggctggagtgcagtggcacaatctcggctcactgcaacctccacctcctgggttcaagcaattctcctgactcagcctcctgagtagctgggattacaggtgtgtgccaccacgcctggctaatgtttgtatttttagtagagatggggttttgccatgttggccaggctggtcttgaactcctgacctcaagtgatccacccgcctcagcctcccaaagtgctgggattacaggcgtgagccacagcacccagcctagtcctttataattgaaaaaatgtatttattgaaaaactttcctagtaaagtttttctcattttgctgtgaaaacattgctgtataataccagcctgttctgtggactgtaattgaagaactactgattcaaggaatgggcagaggaagagaggccagcaaaagagaccatgaggaatggttccagaggcaggaggaaaaccaagaaagcgtgatcatggaggccaaaagaggggagagtttcggaaatgaggacttggccaatagtgtcttttgccacccagagttcaaagaagtgatcaaatttggcaattaggaggtcattggtgacctttggcagagccctttcactgagataatgtggctggagccaagctgctcttggttgaggtgtgaatgggagccaggaaaagcggaagtctagcatgtagactactttcaacaaatttgagagtgagggaaagaaaatagagagaggaaagaagggagggagagaaagagatcaagagagaaagagcaagttaggggagcaagagaacatacagtggagggggagttcttgttttttgggataacagagacaggcattttataatcaggagagaaagagctggtgtagagaagctgaactttcccgaagacaagaagcataacaaatggctggaggaagggcccaggaaggaggtggatgaggccaaggcccaggcaaagggattagcctttaaccagaggggcaccttgtcccctgagaagagagggctggaggggaaggaagttggaaaggcaggccaagtttgaggggggagtggggcatggcactgaggtaattcacgcttgaaggcctctgttttctcagggaagtagaaggagaggttattctgtacagagagaggggaggggcaggaacgtggtaaggagctgaaggaagtttggaatgtggccaagcgaaatgtggaggctggagctggggccttgacaagggaacatgctcaaggatgactgaggggcgctggggtcaactgagattgatcgagtctgtcttctctctgcgggtcttgtctccttcgctaagcttgaggcagagtccatggcactttcctttcctgtctgtccgttagctaggcaatgctagccccagtactctcagaaaggtctggaaaagcaatcactggcagaacccagaagcactatagggctgttaggggaacagaggtaagatcttaattgctctgataggaaggtctccatcttggttgatccataccttttctgctgccctgctgaccagtttactcctgttttgttttaagtgaaaaggagaacagccaacttttgcctagcaacacttgcaggccttaaatcttacaggccggggaaaagccaacaagaagagccagcggcttcatgtcccacaagctaaatgaggctgaggcaattcctaggaggtagcaagacagagccattgcgtagggaggacaaagacccatggaaacaggtctgaaggctccctgggctccaggagagcatgctgggagctgggtgtaagtggaaccctgaggcctgctgctcaggggagtgaagggactggacagctcctaacgtgaaggtggtgactgaaggaacacaagttcaaggtgggaggtggcatgatgggtggcatggttgagtctggtcaggcatgagccccgagctcaggaggaatatctgcctcttagccctctccctccttccttctgctgattctcggaggccacttacaggtggaaaagatccttgagtgtgacaacaggtgttgtgcttcttcctcctttgcacaccatctccttccagcccagtcttttcagcctggctccctctctgagccacactcctcctttcagccagtgatgcagtcagtacaaggaaacgcttagctcatgaaggtaaatttagcaagaactctcagagactgatagatgctctggctccccagcaaccctctctttccccacaagatttccctcttcaggacctgggatctatcttgcacttagaaaattcagggacagagagctctctcaagtccaaggcagcacatttcactgaactcatttcacctcatataataaacctctgtttattgagggccgggaccgtgccaggcccttgggttaggtggtgactgagctgttagaaagttttcctttgattgagccaaaatgtgtctccatgtagcttccagccatgggcctcagccctgccctttgaagtcacccagaacaagtgtaatctcattgcagtctaatcctcagatatttgaaaatatctgtcatttcccccagctttcgttcctccatggataaacatttctttgttggtttatttttattttttgtgcctttcctttttattactcaaataatatcagttcattgtggaactttttagaaaattcagaaaaacataaagtaaaaatccaccccactgttactcccagaaatgacaaccctaacactctttcttctcaccagtcttattttttctctgcacgctgtccattctacatcttttttcttaccaaaatgggatcatcctttaagtaatattttagagacttattttgttttcactctttcaatatgttaacttttccctcattcttctaccatgccaattttaatatgaaattgtgtaactgcccaatgatttatctaaccagcttttaaaagttgttttcaattttcctttgctgaaaagaacatagtgggactagaattggaagtggggtgaagatggggggtaggtgaacagagaaatgaggagcccttaaattagtcatgctatcttaccatctgatttttttttccattttctgtgttgaaaaattatacttcccagaacatgattgtgagcacctgcttggcattcagttgcaaggatttgccctaattaatgtaactggtttcctattattggacattgaagttgtttctaatttttgaccattacaaaccagactgtgatgaacatccaagaagctaaatctgtgctggggctggacactgaggtcaggaggaatattttcgagacctctgaagcataaggtccctgccagtagttgtaactagaagctttctggcaaaggcccagaaggctggctaaggccgaggactgtgctcaggcctctgggcttgcccgggttcagtacccatttatgtagcccctgtcagagagtgttcaggctggcatggtcctatgagaccactgggccagcaccctcatctcttacatgagggaactgaggcctggggctggggctggtccttcggcagctctgtagtcgggcagaactttgcctctccccagcaccctggcttctgaactggaagctaagctctgaggtttggaatctcacccagaggccctgtgaaatcctgcctgctctccttcactggaccacttactgctgaggctggagggggcactttgacaaatgaactgatcagtaaggggctgaggggcattgaaagaagacttaaggtttacccaacaagcatctgggcctgctctgcccagaatgccccttttttccctaacccagatgatatgcttaatggcagtcaccctacattcaggtccacctggcaaatctatctgaggttgagctgaaataacaagtgagtccctcactctccttaaaggggtcagctgtctcttcttgccaggaactggcttagttaaaggcctgtctattcagccctctgtccctgacatctctgtggtttcagagtgctaatgagctcctctccttcccctctcaggccttgctactccctggggaattcacacaaatggtgtgcgatttgccccttctgtgtttttctttctgacttggaggcaaagcaaatccctcacctcccactgacaccatgtttattcaactgggagagatttcacacccaggtaacccagctttccctccctgagccccttccctaaatctttatccccctcccaagtcatcccacccctgtcctccctgaataatttataagaccaggcagggcttataaaagggtctcccaggaaaagccaaaagagtgcagaaggttctgggaagtaggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaaggtaagttgagcttagcctttggcaacctgaacttaggcttgagagcttcctgagagaggaaggaaaatgagatgtccagggcaccctgttctctgtgaaggggaaaagcaatggcctcatagccctccctcctcaactctagctggaatatctcatctgacttttcacctcactaatcccgctgggtggcaagaggggacttggggacagctgttgccaaagctgaaggtgaagcagccaggtcctcataggccaggtggctgagtcccctgagggggatggggaactgccatgaaacctgggcttaacacaatctagactgtgggggtggggagtttggggaaagaggaccaaagtctaaagaggcccttgactgggacattgtctttttcctgaccacgccataagatttccatttgcttttttcctacctctgcaagtccagtggggaagcagtggacccaggaacatttctggccctcttcttcagcccaggaagatggtagagctctgagttctacatcttggagcaggaagtaggaggcaagatattttccatctagcccccactcattactccaaacatttagtcttcaacaaacatttactgaaacagctactgtgtaccagacattgtactaggtgttgaggattcagatacgattgagcatatctttgagcttaagaagcccaaagacaagtaaatagacaattacaaaacagcatgataaaagcaataataacattgctgaagccgagaggagggacatctgtcctggaatgggctcaggagccttaggaaaggcttcctggagcagatggcacctgagccaagcttttgggaggtctcttgttatctcagggagcccacctttcagtctcttcctctacggattgatctctcctctttgtcccagaggaacttgtctctggaggccctggctgtcttccacaaatgactccccaaggcagatgaggaagctggtggatttggtgagttcgagcccttgtgacgtgtgttcacatgcagccacatgcattaacagtgaccaggtcacttcccagagagcccctgacctcagtccaaaggtgcagatctgagatagcatcctcacagttttgccaacatttgattccaacagagagcagatccaagctttctgtggcaattggaaagatgaggagaccaaagctcagagtgggcaagggatctgggcaggccccacagccagtgtgtggcagtgctggtgcttgaggcctcgtctcctggcaccttactccagtgctctcccacccacccgatctccctgaatctttgctgctccagtagaacactgtcccctggagagcctccaaacaggtgctggaacagaggcagggaagcaaacaacccgcaggactctgtctgcttgtttttcaaccagaaccaagagagaccccttgttgaggggtgggtattgggggttgctgggtcccagagatgtctaaggtctcttcaagatcattttacctgcagctttctgacctctagtacagaggaggaagttatctagccatgtactttgagccacatgctagcttttgctttggacaggctgctggtggggcaacggctgctgaggtcaccaaggctgaatccaagttccatcaccctgtcaggtaagcttctggcatgaagctccaaacttgacatagatccattagctctttgaatcttcacaaaggtcttgtgaagcaggagaggggaggaattgctatctatgatcgctgtttcataggagagaaaactggagcccagagaggttaagggactttgccaaggctgtcttttctagaggcattgttaacgatgcccaagaatgatcccccatggatgggtcagtgaaataatcctcagtggaaggagatggggccatagggctggagaattcttggctagaagctttctggggtaggtagcaggtggagtcagagccataagtgacagatgctggggctggcccccgacccaaccactataggtccataagggtttaccttcctgcgtggggccactttgtaacaatgcagaaggttctgttacaaaactttctttcttcctttccctctgacctcattgttgcagccaagagaaggggtttaggggccagcttctttcttggccctactggcccctctgcacatatgacacctgttaggggccatgtttcttctctgtccacaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttcttggaactgtgctgatttcttaactgaactctgcccatattgtgaagccatgggcagaggttcagagaccagctcaaggccaattcattgcttttcctacctgaggtcagttgacaagtttttcttcatggggttgtagggctggagacccagcatggggccaggccctctccatcaatttgtgaaatcagacttgattaaactgcaaggatggcttggaaagggaacaaaaaggtcccaaagggcagcttgtaagttgggagtagggatgcaggttagaggggaaatgtgacaggtgcagcctcatttgagcctcagagatggctgtgtgcatgtggggaggagggctactaggacctagcaatttttttcctcaattccctttatatttaccacagctcagaccctcatgcttacccttgctccaattactcttcgactaaattttttttttttttggcctccagctgtccctttgtgattcatcttccacactgacaaccagattagaccacatcatgactttgccaacacttttgggcttatctttttttttttttttttttttggtcacagatccccttgagaacctgtggcttctctactcagaaaaatacatttgttcacaccacacgcacacacacacacacacagtgctatatcttcacaaatcaagtacttaacttgatattctaggcctttcagttgtctgggttttgcctgtctcttgagactcatctctcaactcttgaagtttacactgcctctctttgaatgtggcatgctttctaacacctctgtgtgtgtccttaaccctgtctggaatgcctttccactttcgcatgcctaggaaactctcattcatctaacagaaccagctcagacacccctgctgtaggaagcctccccagacatcccaggcaccaggttgggtgcccccactcattcagagcctcccctaccatagcatttgcctcctttcctatacagtaacctggggctgtatttgatattcccatatgacttcattgcacagaacactgcctggcacaaaggaggtgctcaggaaatgttgaaagagaaaagattctcaaatcttctgaaagtagctcttggtggaaccaccattgttcccccaacttgctggcttcctggtttagctacaaagggaaaagggtaatgtcatttcattcaggagcaaaacgatgaccatctttcttttccttctccctcagcatgagacaggctgcttcagttctaagccctagctgggacttccctgcattggacacaaccttgagtaagccaccaaactcacacactggtgccatctattggtcaaaatttaaccttgttctttaattaaggcttccaggcagttgacctttgactgcattaattcttttagtccattctgtttctgtttgtaagtaaagtggaatctaccatgtgctagcagtatgaccttgggccagttacttatccactctgagtctcagtctcctcgtctgtaaaatggggctaataatacttcctttcagagttattgtgaggattaaatgatatatgtaaagtacttagcatgccccctggcacatagtacaaaccctcaataaatggtagtagtcataataatagtagtcttagtagctgctattgctgattttataaaggaaatgatcttataggccagagtcagctaatgacgatttactcaactaataactgatttgtcagttatcaccacttgatcttcctggcaccatttgatggtttaccggtaaaagcatcttttcagtgtttattccaaaatgaaaaaaaaaaaagaaagaaagaaaccgcccccccaaaaaaaaaaacaaaacaacaatagaggcgaagtgtggctccctggaccactgtctacattcaaatggtaacccacaggttttagctccctttttccaaggccagaggtttgtaaacgtattttttgtgctttagcaggaaaacctttcttttgaattgaatgcagaagcccaatatataaatcaaataaaaatggagctatcctggtggaagccataatggggggggggggccagaattcttatgctggtgtcttctctccggtaaagtagctgtctccacccctttctgggaggcactttcaaggatccctagactgtggaaaacacaatttggaaaccactgttccaagggttaaaccaggattgatttgaagtagaagggagattaattagtacttcaaaatgtccagtgttctgtttaaaatccttgttttgggtcctaagcacccagcatttcacagctcaaaaattgctcgaatccttataccataggttatagggatttaaaatccttggaatcccaatatccttggttttaaggtattatatagcatagtattacaaatccctaaatcctcagggatttaaagatcctaaaacccttggagcagtaattcgtaactcagaatgggctcttctcattttccaaccccgccctccttactgcacacttgctgttgtttactgggcagacattttgtctcgctgtcctctccgtcccctgtcctgaaatggcttccagtcctcttccccatacgtggttgctaagtcattggaattcactgttctgactaatcagagctcagtatgagttactttgttatgggcgtttccaatccttgtgccaacttcaactccagtgcacaaactcaggagaaaaatctctgtgcaaaactcaagagtccttcctccagctccatttggctggcccatcctagtgtcccagcacttccccatcctagcactgatttcctcctgtttctcccaccttgttgcagcagtgagagaacacatctgttggggtgaggctgcatttgagctgggctttgaaggatgggcatgagtagtaatggagggagaaaacttttcagaaagaggcagcactatgaatgccttcattaaacaatacttattgagcacttactatgtgccagcccttaacgttgtaatgattaggagcatgggctttggaagcagatgaacatgggttcaaatgccttttctgctgcatgctggctcaaatcataggcccactcccctcaagtgtcaaggtcagctctctgctcttaaccctttcactacaacctctatagttttttgtttgtttgttttttgagacagggtctcactctgttgcccagactggagtgcagtggcacttggctcactgcaacctccgcctcccaggctcaagcaattctcctgccttagcctcccgaacagctggaattacaggtgtgcaccacgacgcccagttaatttttgtatttttagtagagatggggtttcattatgttggccaggcaggtcttgaactcctgactgtagttctttattgtgtcacacctcttccccacacagcacatgctcattaaaatagtcgcctattctcctttgcctcagcacggaaagccctctgcctacccagtgggtgttacaaaccctcacctctcaccccctcctcaaaactgtgcctgtgtgacccatctagtgggtagatacattgtctcctttcctccccacttcccttttgccaaatggtggccaatccccatcccaaataaggttgttagcagacctgaatccactgttttggcctatcaggaacatggtgttggttcctgtgtttttggtttatcccctggctggcaaggctcgtgacaacctccatggaaacacagaaacccagatacagaaagccaacaaggaatgactgctctgacagcgggtgccacagcacttgctactgacgttacacccatcatcttgtgtggtacttgtaatcacaacagtcctagagataggtcttattattatccccacttattaatgagaaaactaagagttagctgggtttctgtgcctgggtttgtgtgcctgcatggaagatgctacaagccttgtcagcagtgattaagtaaaaaatacaggaaccaacaccaggccatgacaagtaaaacagtgaagtcaggtcaccagtttacaacaggagactggagaagagaggagatgaactgtctgtccactagagagccataaagtcacagtgcggggtggcaggggggcgggggagtaggaggtggtgacacccacaggtgtgggagtggggctttccctgtccagagaagactagacaataggatacctaggaggataagagttagaacagctgataattctggaattcttgttatgaaccttacatggattaactcctttaatacaacaactttgaaggataggtacagttgggaaaactgaggcttagagtggtttttaaaacttgccccaaatcacacagttggtaaattgtggcaccttctaagcgtcaggctttttacacattttacctcattgaatccttatggcaaccctaaaactcaagcactattattttccttgttttatggatgaggaaactgaggttcagagaggttaaggaatcttaaggtcacgtaattaataaatgaccgatccaagatttgagagatgacagcaattgctccaggttacattaatggtaagtggcagaactagagttcagggctgcctgacaccagagccctgtgctttcaggaggtggaatcaacagggtttgctgaaggattaaatctgtgggagggcaagggagaaaagatttaagttctggctgcagggaagtgagtcagaggatatgaagaactctgggccaggggccaggaaacactgagggcctctgaaaggtgtcactgagggaggaatgtttggggacctcctgcccggcagtggcaggctctcacagcacctgggctgtgggcacagggctaccaggggtgagagggggatgagggaattctgttcctgcccctcggtgctgtgctgcctcagagtggaatgggccctggctgggcatgtctcactctggctgaaaagtgggaggaactaccaattgctgagctctcccgttctatcccaggcactgtgcttggcaccacacacactttatcctgaactgggtggtggtggtggtggggcatcctaatgtttacagataagaaactgggactcagagaagtgaagtgacctgttagtagcacaggcaatgagtgggaagctggggtagaacaggacagtgcgactacagagtcctggctcttaactactaggctcctccttccctcctccttattcccccagagaagccctgaaagtcccttagggcaggcagctcaccctggcctcctgcagcctacggggaaagaagtgtgtaaactgtcacaaaaaggcattgctatccccatcactggggacaccttgaggcctgggaccaagtgtgaattaaaagaggttgagggagagaccaggaaccagctggagtcaggctctgggtttttctagaagtcttccatccaagggagagaacagcggcctccaagtccctagcgattcaattcgttttcgctaacagcaagacaggcagccccctctagtggctgagctctaaacctacagcacaaagcccaggatgagcagggctcatccatccagaggattctatggccagcactgttttgtacctggtggttatagggacagactctggatttaaaccaaacctgggttcaaatactggctcgactccttgttagctaagtgaccatgagaaaatgtctctaagccttagtttcttcatgtataaaataggaatgataataataccattttaacagggttaatgtaagaattaaatgagacagcatatgtaaggggctggcagagtacttggcacattacagatgtgatagagacatgcacatatatttatatatacatgtacacacactactatacattgtgcataggtgtatatatgaatgtatacacatctaataattgttcttttttgacacatgctatcataatagtcgtcaccactttgacttcccttgcctttcccatctgatatggtttggctgtgtcccccctgcccccaatctcaagttgaattgtggttcccataatccccacatgtcatcgggagggacctggtgggaggtaactgaatcatgggggcggttacctcatgctgctgttctcatgatagtgagttctcagaagagctaatggttttattaggggcttttccccaatttgcttggcagttatccttgctgctgccatgtgaacaaagacttgtttgcttctccttccatcatgatcctaagtttcctgaggcctccccatccctggggaactgtgagtcaattaaacctctttcctataaattacccagtcttgggtatgtctctattagcagcatgagaacagactaatacactatctatctagctctactaaaccctggtgccccaattactgtcaacacactcccctgaagcttatgggaaagacatgggctaagatacttgcttttctccatgcacactttcaagaatcttggactgcacatctttgtccttcaatattctgggaatgttaataagcttgctttacacaggtgctacgctctttctgtgtttcaaagcaactttacctccgtgatctcatttgaatctcttaatactcccagtactctcattttttttcattttgttttagatacggggcctcactgtcacccaggctggagagtagtggctcaatcatagctcactgcagcctcaaactcgtgggttcaaacaatacttccacctcagcctcctgagtaactaggactgcaggcgtgtgccatcatgctctgctgtttttttttttttttaaatagagacagtggtctcattttgttgtccaagctggtcttgaactcctgggctcaagcaatccttctacttcagccttccaaattggattacaggcatgagccactgtacccggtaacatttttaaatgaggatattgaagatgatgacatgggaaatgacttgctcaaggttgcatagcaagtcagtgcaggagtcagaactaacctccagaatctcgatgttgagtccagtgctttctaccaacccttgcaatcgtccagggccttaagctctgactaaatatgaagcacttgtaatccaggacagaacttacttttgaaggccacaccactacactttgacaccaatctcctgcttctactgaggccaaggttgtatctccaggaaactatcaaactatgattctttacctataagaagtggtgccatgttgccaggactggtgacccaagacagctacatctccgaaacatgcaaagaatacaattaaatgttagatgatgggtttgcagagaggtgaacattatcttttcagccaagctgcatgcactgctaaagaattagctgctgtcctgtactcacagccagcttgacttagccactctttttgtgttggacataaccatcagtgtctcagaagggcagccttgtccctagtcagcacaaaaattgggaggtgttgatgcatgtcagcagcatgggtcctgatggcagcatctgtttgtaggcactgagagaagcagtacgataataactcaaagctctcagtgtcatttgatattactttgggggcagaggatgcaggcttggctgtcagtagcagtggccgtgttttctcattctaacacactggtgacaaaatgagcactgctgagataacaaatcatagagcccaaacaccctctccctagcccccatgtgacactggcaagcttggttctgctcagaggggaagcttgttacttccttctggagtgttggatctctgggtggcactgaatttttctttctgctatcacttgttttttacttgctcatcaccatggcaactcgagagcgggagccaacattgaaatcaatctctccccaatagacatatgtggaacagcaagtgtactccctctctaatattagggaagcaaaacatttttaaccctctctccgtgcttcagccttggtccgtggtgatagaaaatactttcacctgcaatttcgggcacctttgctcttcctgcatgggagtttccaatctcattggtctgaggccaatcattgggccacagctcaccagtgactcaggtcattacagtgaaaagaatcatacacatctgtgactagatagccggttccacttgctgctggatgattgggtcaggccaaatttgttctgaagactttagcttctcagattcagagtgaagggagtagcttaagctgcactttccaatcaatttttttaaaccaaagaacctgcaacagaaagaggagaacaaggttaccaagcctatgctgaattctcagatcaagcgtttattaataaatactttgcttactattctactattgctcattatacatataattttcttggtgggaagggttgaggagaagggtaagattcaggaattcaggaataaaaactccaacttgaacccacaacatctaggaaggtttgcccaaggtcaaagtcttgtcccagcctatgtctacactgggcagaaaggatgcacgtgttcaatttcctcaccttccactgatttctcgaggattttgggagtacatccaattgaaaatcaaattttatattgagctttcagtagtgtgtaactcttgcacggataccgagacgtgacctgcccatgtaatgaaatcgttagcctgggagtaggagctttgccttggactaacagtcaaatttccccctgctcaaacacaaccatagaaacttgagtaccaaaacgttcttggaaaactgttgacaatttccacgtgtaagaaagccctgaaataaaaagccattctttgtaaacttagcagatttttttgagtggatatttaatatcttctgagatgggggcagtgcgctgggaaggaaagggcaccaagcatcaggagactgactcaggtacttgtttagttctgtcatttattacttgttcagtcctctaatacgttggacaagtgatttaattttctcatctctaaaatggggacaacctttagcctatcaacctcgcaggtttttgggaatgaggttccagtatatagttatatgattaaaccactcagaaaactgtaaaatgttacataaagttgtattttataagcactgtgaaaagaacttcaggataatagtctgcctttcaaaatgcagacacaagcgctataaatttctgggagaaacccttggcgatcttcatagaagtcattcatgcaaattgctagagaagctaaacctcatggcttcacttaaaaaggtagtagaaatagtttttgtctgcccacctttcctggataccccatttcctaatcaacttggggcagttttccaagaggccctgtatgtgaaactgtaaatgtgggagcagtaactttgcctgaattactgagagtggtgacatttggtggttgccattggcaatagcttacaaaatctgaagttcacattatttctccgaggctaggctgcttgtgcatttgagtaacacgaacatattatttcattcttttttttctttttttgagacagtctcactctgttgcccaggctggagtgcagtggcgcgatctcgactcactgcaacctccatctcaagggggcaagcaattcttatgttttatataactccagaaaatgtccaggcgagcgccagcatgcccagctaatttttgtatttttagtagagacggggtttcatgttggccaggctggtcttgaactcctgacctcaagtgatctgcctgcctcagcctcccaaaacgctgggattacaggcgtgagccactgcacccggctacatattatttcactctgaaggcactcagcatgttagtaaaattgactttttttttcctacaaacaactttaaggattcatactatttaaactccaaaaaggtagagggaaattttcagtttttttttctctaaaatagtggaaaaacttacaaataatccataagagaataattccaggcacaagaacaccaccaaaaatggtaggcaaaattccaactgaccaaaatgtttgctgaaacataaaaagtaaaatgaagatagagtcatgggaatacaaataaaatgatcaaaggtaggagagtttctttttacttttaagaaaaggaagggtgaagatactagtttttatgtaaatattatacactttttgtggactcttcccctattagatatatggaaaaccatacataggctcatgaggagttagtagaaatgaaaattttgctcttcctatctgaatagaaggtaagaatcataaatgtagatgtttgcagtgcttccttatatctatttttatgagtccaataaaattgcatgcagctggagactccacaactttaaccaaatagaaggcagtaggattagactgggcatggtggctcatgcctgtaatcccagcgctttgggaggccacagatcacttgaggtcaggagttcaagaacagcctggccaacatagcaaaaccccctctctactaaaaatacaaaaattagccaggcatggtggcaggagcctgtaatcccagctacttgagaggctgaggcagtaaaatggtttgaacccagaaggcggaggttgcagtgagccaagatcacaccactgcactccagcctgggcgacagaatgagatcccatctcacaaggggggaaaaatgacagtaggattaaaaataaagaaatagacaggggattgaataatgaaccctctttaaaatgtttagtatccagaagtgcaaatctgtggttgtgctaggctgatgacattagatgtgattttactttatttcctctttttttctaaatgttccttaaagggctttcattgtttttagactttaaagttaatggttaagacagttggaggaaaaaaagaagacatattaacttcaaaagtgcaacaataaaactgacaccttagagaaccaataaaagccaaagacaaaagaatgagcttatcaaagtgctggaaaattaaaaaaataaaagcaaaagagtaatctagaacttgatatccagtaaaaatatctttgtaaaattaaggtgaatatcctcacacacatatgcaaaattgatttttatcaaagatctaaaagcagccatttcaaaaaatggtgctggaacaatcagacaggcagagacaaaaataaaagatgaaccttgatctaaacctcacatcttatacaaaaattaactcaaaatggattataaacaaatgtaaaatgtgaaattatgaaacttttagagaaagctatagcagaaaatctgtggtatctacaattaggcaaagatttctagacttgataccaatatcatgatactatataagaaaaattgataaattagacctcattaaaattaaaaacctgtgctctgtgaaatgtcctgtgaattagacagaaagacaagctagagactaggagaaaatatttgcaaaccatataactgacaaaggactcacatctagaatagaaaaagaacttttaaaactcaacaataaagaacccaaaacaattcaattagaaaattggccaaagacatgaacaaatatttttccagagaggatatatccatagtgaataagcatgtgaaaagatgttcaacatcattagctgtattcatttgctagggctcccataacaaaataccacagactgtgtggcttaaacaacagaaattaatttgcttacagttctggagactagaagtccaagatcaaggtgtcagtagtgttggtttcattgtgaggcctctcttgtagatggcttgtagatggccattcttgctgccttttcttatgattgtctttctgtacaaacgtgcccctggtatatccacctcttcttataaggacaccacttatattggattaacgccctaatctaatggtctcattttaacttaataacaattttaaaggccctatctcaaatatggtcacattctgagttactgggggttgggacttcaacatataaatttggaggggacacagttcatccaataatatgtaataagaacataaaaagatgctcacattggggaaatacaaattaaaactgcaatgagataccactagatacctactaggatggttacataaaaagacagacaataacaagtgttggcaaggatgtggagaaaatggaaacctcatacactgctggtgggaatgtaaaatggttcattcactttggaaaacaatttggcaggtctttaaaatgttacacatagagttaccacatgacgcagcaatctcactcctaggtatatatccaagagaaattaaatcatgtccacacaaaaacatatcatgaatgttcacagcagcattattgataatagcaaaaagatgaaaacaatccaaatgttcatcaattgttgaatgaatatatagattgcaatatatccataaaatggaaaacaactcagcaatgaaaaggaactaactgctgatacttggctacaacaggaatagcctcagaaacattatatgtaaacgtagccacatgcaaagaccaaatgttttatgattccatttatattcactgtacagaaaaagcaaattacaaaaggtagacagtagattagtggttacctgggccaggaatgggaatgaggattgggagctctctttggagtgatggaaatgttctaaatttggattttggtgatggttgtaaaactgtaaatttacttaaaaatcattgaattttacatttaaaagtgtgtgggtttgcattgggcacagtggctaacatctgtaatctcagcactttgggatctgacacgggaggagcatatgaggtcaggagtttgagaccagccagggcaacagaacaagaccccatctatacaaaagatttaaaaattagctgggcatggtggcatgcacccatagtcccagctacttgggaggctgaggcaggagggttgcttaagcctaggaattcaaggctgcagtaagccatgaacatgccactgcactccagcctgggtgagagagtgagacactgtctcaaaaataaaaaacaaacaaacaaaaaacaaaaacaaacaaaaaaggatgaattttgtggtacataaattgtatctcaaaaaagctatttttacaagtatatgaacaataaaaataacatcttataaaataaaacaatgctacatactgtatgattccatttatatgaaagtatagaaaagccaaaactacagtgataggaagcagttcaatgttgccaagggtgaggagtggaaggaggagattgcctcaaaggggcccgagggaactttttaaactgatggaaatgttctatatcttgattggagtggcagttgtatgagtgtatactttttccaaactcctcaaactgtttaaaattggtaaaatttcattatctatgcattatctctcaataaaattgatttaaatatttttaatcagtgaaagattttaacagacttcacaaaagatgataaaagaaacatctataagtacattaagtgacattggacttcattagccatcagtgaaatgcaaattaacactacaatatgaaatactctacataccctctagaatggccaaaatttaaaaagacaaactttttaaaatgccaagtgctggtgagaatgtggaacaactggagctcacatataccgctggcaggaatgcaaaatggtacattaatctaaaaaacagtttggacgttccctaggaagttaaaaaatatgtcccaacattttcattcctgaatatttaccctatagaaatgaaaatatgtttacacaaagacttgtaagcaactgttcctaacaacattattcataattgcccaaaactgggtacaacccaaatgacaatcaaaaggtgaatgaatatacaaattgtggtatatttatactaatggaacactaaaaggaataaacttctgatatgggcatggatgattctcacaaacattatgccagaaatggcaggcagaaaaacttagtgtatgactcagtttttataaaactctagaaaagataaatctataatgacagaaagcagatcagaggttacctggaacctcatgagggtaggggaggttgacctggaacaagggaactttcagggtgatggaaatattctatatcttgattgtggtgtggttggttacacgggtgtatacattttgtaaaaatcatacattatacattttgtcaaaatgtttactttaaatgagtgccttaactctgtgtaaattatacttcagtaaagtttactttaaaaaataattagaaaaatgcaaattaaaactgcaatgagatactattttacacccaccagactggctaagatgaaaaaagatagacgataccaagtgttggtgaggatatacagatatcagaactcttatttatgactgattggagtattaattggcacagccacttggaacattatttagccgcatctatcaaagctgaacatatacatactctattgatgtagcaatttcacttccagatatttaaatatatacccaaaagaaatgcataaatatgggcatcaaaagacaaatataagaatgcttacagccacattatttttatatcacgaaactggaaacaatccaaatttccatcaacagtagaatggattttaaaaaccacaatatagccatacaatgaattatcacacacaataaaagggaatgaactgctgatacgtcacataaatgaattacaaaaacataatgttgagtgaaagaagccaactaaaaaaatgcatgttgtatcatagccataagattcaatttatatagtttttcatgttatttttaatggacatataattgtacatatttatggaatacagtgtgatattttgatacatgtatacaatgtgtaatgattaaatcaaggtattaatgtattcttcactgcaaacacatttttcctcatgtgctgagaacattaaaattatctcttctggttatttgaaaatatacaataaattataaatatagtcagtctacagtgatatagaacactagaacttattctcctatctagctataatttcaatatctgttattatccttccctccccctacactttccagcctctagaaaccactgttctctatttctgtctcaacatttttagcttctacatgagtgagaacatacaatatttcactttctgtgcctggttcatttcacttaatataatatgctttaggctcatccatgttgccacaaatgacaggatttcattctttttatgctgaatagtattccactgggtatatgtaccacattttctttatccgtttgtctgttgatggacagttaggtagattccacatcttcactattgtgaatagtgctgaaataaacatggtagtgcagatatccttggacatactgatttcctttcctttgaatagaaacccagtagtggtatcgctggataatatggttttctatttttagttttttttttgaggaatctaaatactgatttccatattggctaatttattaatttacattcccaccaacagtatataagagttccctttttggctgggcacagtggctgacacctgtaatcccagcactttgggaggctgaggcgagtcgcttgagtccaggagtttaagatcagcctgggcaacatggcgaaacccccgtctctactaaaaatacaaaattagctgggcgtggtggcgtgcacctatagccccagctatttgggaggccaaggcgaaaggatcacttgggcccgggaagtagaggttgcagtgagtgatcatgccactgcactatagcctgggcaacagacggaaaccctgtttcaaaacaaaaaaaaagttccctttttctccacacccttgccagcaattcgttattttttgtccttttaataatagctatttggactggggtaagatgatacctcactgtggttttgattggcatttccctgattagtgatgttgagcatatttccatgtatctgttggccattttgtatgtcttattttgagaaatgtctattcaccttatctgcccatttttaaattgcatcatttgagggttttgttgttgttgttgttattgatgtgcttaagttccctgtgtattctggatattgatgccttgctggatgaatagtttgcaaatattttctcccattctgcaggctatcttttcactttgttgattatttcttttgccgtgcagaagatttttagtttggtatagtcgcattgggtctatttttgattttgttgcttgtgcttttgaggtcttatccataaaatcactggccaaagtcctgaagtgttttccctgttttcttatagtagtttcatattttttgtgtctgacatttaaggctctaatccatttgagttaatttttgtatatggtgggaggggtctagtttcattcttctgcatatggatatccagttttcccagcaccattaattgaggagactatcctttccccaatgtatgttcttggtacctttgttgaaagtgaactccgctgtaggtgtgtgaatttatttctgtgttctcttttttgttccattggtccatgtctgtttttgtgccagtactatgctgctttgtccactatagctttgtagtgtatattttgaagtcaggtagtgtgatgcctccagctttattgtttttgctcaggattactttggctattcagggtctttattggtcccatgcaaatttcgggattattttttctatttttgtgaagactgtcattggtattttgatggggattgcattgaatctgtagatcactttgtgtaaaatacggtccttttagcaatattaattcttctaatccataagcatgagacgtctttccattttttatgttctctttaatttctttcatctgtcttttatagttttcattatagagatctttcatttaccttgttaaatttattcctagctattatatttttaatagctattgttaatgagattgatttcttgatttctttttcagctagttcattattggtgtatgaaaatgttgctgatttttgtaagttgatgttgtatcctgcaaatttattgaatttatcagttctaagagtttttgggtggagtcttcaggttttttctatatataagatcatgtcatttgaaaacaagacaatttgacttcctccttttcaatttgaatgccctttatttctttctattgcctattgttctggctagaacttctggtactatgttgaataagagtggtgaaagtgggcatctttgtcctgttccagttcttagaggaaaagctctcaacttttccttgttcagcatgatgttggctgtgggtttgttgtatgtgtttttatgttgagacacattccttctatacctaatttgttgagagttttcatcatgaaaagatgttgaaatttatgaaatgctttttctgcatctattgagatgataaataaagaatgtagtacctggagtgcttgcaggtgataacatttcaaggaaatagaaaactggagattattacataatctggttgagtttgaaagcagtgataattcttttagtattataatacgggatgttagtggtacatgtgcctattgaaggcaaggctagatggaccaggtaactgccactacagattattttagcactaataatgaacccaagaattgtgaagtgggataactttttctaactgtactctacagtttaaagaaagaaaatggctacattgggatatacatggtcagcacaagaaacagacaactacgagtttctattcccttatttcttgttgatgtagaactgacatagttgaaaattggccacagagtctgatataatgggtcattaaattatagtatacattgaactcacagccttaccggttcatttttatgaaagtaagaatatttatcaggatagagtgagaccacccaagaatagaaatggggacatttgatgctcgtcaatgatagattggataaagaaaatgtggcacatatacaccatggaatactatgcagccacaaaaacaaatgcgttcatgtcctttgctggaacatggatgaagctggaaaccatcattctcagcaaactaacacaggaacagaaaaccaaacaccgcatgttctcactcataagtgagagttgaacaatgagaacatatgggcacagggaggggaacatcacacacgagggcctgtcggggggtgggggcaaggggagggatagcatgaggagaaatatctaatgtagatgacgcgttgatgggtgcagcaatccaccatgacacatgtatacctatgtaacaaaattgcatgttctgcacatgtatctcagaacttaaagtataataatttttttaaaaaaagaaatgtgtacatttgggtagattcagacaacctaagtagtttaccaacaagtatgctttgccaacagaagcagccccagtttcataaggctggtcctgccttccttgaacgctctgaatttacttttaggggaatgtcaactttcttcataaagcacccctaccctcctcattgctttcagacttataactagagtcagataagcgtatgctccaagagtacaaatatgaagtctgacctggaaggagataagaattgcaaaattttgctaatttataatgacagaaatctggagaatatgtgtaggaatgtgtcttagaatggtatactacagaggaaaaaataatttttgatcaggccaaatagaccaacatctacatatttaccagagagtctaaattcaattgctagcttacctaattggaagtggctctgatcagttgattgatggaagccaaggctcaaaagtagcccatattaaataaagttgatatagcagatattccttggtatgatgaagaggaagtactccaaagacttaaggagatagaaacattggagtacatttatatgattcagtcacctacattttaaccatgtccctcttccaacagggaccagaggatgctttcttactcaaggcattgaaaattaccttaatgagaggagtctcagtatccttgaaacatgctacagtggctgtcttttgtaggctatgacttatggtgaaattaagtctccttaacttcttttttaaaattaatttttgacacataataattgtacatatttatggggtgaagtgtgatgtttcaatacatgtatacattgtgcaatgatcaaatcagggtatttagcatatccatcacctcatatatttatcatttctttgcggtgaggacattcaaaatcttctctcccagctattttgaaatatataatattgttaatcatagtcaccctactattctaacaccagaacgtcttcttcctatctaactgtaactttgtactccctaacccatctctctccatcccttcctccccactacccttccaaccttctggtaaccatgatttctactttcttctatgagatcaaccttttctagatttcacatatgagtgagatcatgcagtatgtgtctctctgtgtctggcttatttcacttaacataatgtcttctaggttcatccatgttgccatgaatgacaaaacttcattctgttttatggatgaataatattctgttgtgaaaatataccacattaaaaaatccattcattcattgatgattacttaggctgattccgtaccttggttatgtaaatagtgctgcaacaaacactggagtgcagatatctattagatgtactgatttcctttcctttggatatattcctagaagagggattgctggatcatatggtagttctatttttaattgagggacctccccactgttttccataatggctatactaatttacattcccaccaacactgtgtaagtgttcccctttctccacattcacaccagtatttgttattttttgtctttttgatagcagtcattctaactggggtgaggtgatatctgattgtgcttttgatttgcatttccctgaagaaaacggtgaacattttttcatatatctgttggccatgtcttcttctgagaaatgtctattcaggtggtttgcacatttttcaattgagttgcttcttttttgctgttgagttgtttgacttccttgtatattctggattattagctccatgccagatgcatagtttgcaaatattttctcccagtctgtaggttgtctccttactctgttatttcctttcccatgcagaagctttttaatttgatgcaatcccatttgtctatttttaattttgtcatctgtgcttttgaggtcttatcaaaaaaaaaaaaaaaaaaaccttgcccaaaccaatgtcatgaaacatttcccgtatgttttcctctagtcattttatcatttctgggcttatattcaagtctttaatccattttgactcgacttttgtatatagtgagagatagaggtctagtttcgatcttctgcatgtggctatctagtttttccagtaccatttattgaagactgtcctttcctcaatgtacgttcttggtgtctttgttgaaaatcagttggctataaatacatgaatttatttctgtgttctctattctgttctattggtctatgtgcctgtttttgtgtcagtaacattctgttttggttactgtagctttgtagtatactttgaagtcaggtagtatgacaccttgagctttgttccttttgctcaggattactttggctattcgtggtctttcgtggttacatatgaattttaagaatttttttcctatttctgtgaagagtgtcatttttttcatagaaattgcattgaatctgtagatcactttgggtagtatgaacattttaacaatattatttgtaggtctccttaatttcttagttcacgctgccattgtcaggaacttgctaattcaatgagaataatgggaacctagaatggcagagaccaagtgggagaacttaatgactagagatggggtgagcatggttgagtatgataggagcatggccagggaagccatctaaatgttttgacttgcagagatgtttggtagtggctaatttttcttcaggtctcttagattaaaataaatggtagcctactaattcctacttgatttgtatagccaaaatatttccagtctggtgaacaaagacctaatttgagtaatcatgatgcagatttaaggtctttcacccaatttgcagacctgagtcagtttgcacattcagaggctcctgaaggaaaaccaggtacccgtgaggaaggattttgcaataccatgagcatgtgttgtaaatcttcttttaggaagaggaacctgtggccatttaccagggtaatttgcactgggcaaatgacttggactttcagagattatttgacactgactctgagttcacattcattcctgggagagattagagggggttagaacacaatggtcatctagtggtcagaggcagggcttatggagtcaagagatacagttttatcttgaatccatctacaatggatctagtgtgtttgcaaatatattgtatagctatttctcagttcatgaatgtataacttgaaatagccacaatcagcaactgacagatataccacatttgctccctgaccagtgtagtaagaactttttatggtagaaagggccaagtagaattagttgggtctgtcaataacacatccctagggaaaccacagagatgagtgtgtaccaaagatttgaagaacatgcgtgtgtatgggaggtgggggtgatttctatcctaccctcctttaacttgtctgtttggactctgccaaaggtaaagaggtcttagaaaatgatagtcaattatcaaaatttaataatttatctcaaacaggattttttaaaagctggatagatcataggaaactgtagaacactgaaagatcaagatcttaaaagtagtcataaagaaatggcattacctgcaaaaggaagacaagcagaattagaagctaggaaatacattgcttgatgcttctgcaatgggagaaatatgtagttctgaagacagaaatggaaactgcagcataacgtgagataggataaatgtgcttcttttgatgattatatgcctatgaatgtagttaccggaataatttgccttgcctttagggatccggagctacagggccccagcgtcacatgcatcactgttactcttctcgccttgagtgtgcgcaggacctgtgatttgcctttaaccaacagaacatggtgaaagggatgggatgtcatggctgtaattatgttacattatataagacactgtctttctagcagatttgctctagagacttcttgctgccttgataaagtaagtggccattttggggaaagctgatgtggcaaagaactgtccacagaaggtgagggcagctgttaggaactgactgaagcctctagaagctgagggtggctgccaagtgactaccagcaagaagctggcatcccagactggaaaccataaggaaatgaattctgccaaagcctgagtgaacctggaagtggattattccttagatgatcctttacatgagaaccatcctggctgacactttggttgcagccttgtgagatcctctaagcagaagatcgacctaagttgagcccagagtcttgacccactgaaatggtgagataataaatgtgtgatggaattagctatgcaacaatagaaaacaaacacactgttcaatttgctttccaccctcttagtttgcctttctatactgtagaggctaaaaagctaaaagtaaatttcccagattcctctgcaactaggattctggatttattagaggccaatcagatgcacacatgtgagatttgaatgacagaagtgaggtgttggctatgtttctgccatttctgctggtaaacatagttgtgaagatgtttggctgttctattgcaatttagtcatcagtttgtgggtgatgagaggcagggtgcctgccatctattttgctagtgtaagtcacagcagttgaagcatggtttctgaggtagcagcagtagtgatggctttttatgacagcagtaggaagtagcagtgtccttaacactgaagagttagcaattcccttggtggcctgatagtggtgtgcctttggaagttgttcttcaaagctcagtttagtccatcctcctgataattatgtaagccacttgatatctagtaataaatcttttcctgattaaactaactagagtgaattagctctctgcaattgaattctgatacaagagggaagtcctcaagtgatatctgagtgaagtgcaagtaaaaatacatcatagttctgtgtgaactgaaatttagaaaaagaaaaaaaaaaagcctgaacatggtgactcacacctgtaatccacattttgggaggctggggcggtaggattgcttgagcctaggaatttgagaacagcctgggctacatagggagaccacatctctaccaataaataaataaatgaatgaatgaataaataaataaataaataaataaataagccaggcatggtggtgtgtatctgtggtctcagctacttgggaggctgagacatgaggattgcatgagcctggaagatcaaggctgtactgcactccaatctgggtgacagaattagacctgtctgtctgggtgacagattgagacctgtctcaataaagaaaaaaaaaaaaaagaaaaagaaagaaaagaaaagaaaaaggaaaaaaagacatcataataaataatactaatctttttaagtaaaccatttttcatgtttagtagatatatttatttttataaagacaagtaaagccaccttataacatatttaatttaatgcataaggtataatgaactggttcagtttaacacaactacgtaagatttttaatattatgaacaacctgtttggttaacaagatagcagctataaaactataatgtttagtttgtttctcctgcagactcagaaaataaatgttttctttttgctttgcatttataaactttttgcaactcaaaaaatctctttcagtattcaattttaattaatctagcctaaagtataatactcagcaatctgtactattctgactttaaaatcatatcaaatattaataacatatatgctcttaagaaagtacctttctttgtaaatacaactgacaaaatattcagcaaagtgtgtacaatagtgccttgtatacatgtgtctttctagagctacttcagtataatttaacaatcattgcacaatagcagatgtataatagtttccatataaactattatctaagctgtaaaatatggacatagttcagcaaatcatttctgagaaaaggcatagatgtttatttaccaactatctctttaagtggtaatttccttgaaaagacaaggttgattaaataatttaaagacactactagtaagtgtttagctaaaaccaatttatgggattttcaaaggctcaacttgaaaattcttgaacttctttgaaaataacatattctatgagcgatgaagccccatgtgttaagctttgttcacagtggattcttcccaaaggctgactgtaccaactccctccaagaaagggagacctcttgagtcactctgaaggaggtctgccctttcatggtttcacatctagaaaagtcaaaaggcttataaccaaagtcttttctaaagaaagaagctccaatgaatgatttctccccctattttctaagtcaattgattaataaattgtccttggtaggaatagcacaggacagtggacaagtatggtttgctttttttttttttgaaagtgctaacaaagcccattatctctaaatggacttggtgtaatgactgaaatataaacagcataaagtatatagaaattacacatctaaattggatagtcaaaactttttagacagatgtcagcaattctgttaccttggcaatcattacatacaagtatactttatatgcttgccagactaataagataattcagtcttagtgtagccattctttactatctaatgtaaattaacacatgactggtgaaaatccaaaatctaaagctagaaccaaaacagtcataagctactctgagacaaataccacaaacagcagtgcccagaatttctagtgatgtctcggtctaatgaaagacctatacagttaattgaactgtttcttagcccttctcagaaggctgattttacccagattaaatccaaatccaatattgtttttttctttatatcagcccagaatttagagttattgatttgcttttgtcagtaacagagttagcagtgtgagtcagcagcctctgaacccctcaggtaggaagactgtagaaggtacttaaaaaagcatttattactagaagactgaatgagattaacttaaaaaaattaataatatttcagttagataacttgaaaacaagggccccaaatggtaatcttttagataatttggaaagtagggtttatcgattgacatgacatatcagcctcactaacacccaagcataacaccgtcttttcaaaataatcagtaattcatatgtaaatagcaacacaagctagtaatttccttactaaaagtgatatgcttgtgccctctggtggtaacatttagcatattcccctgatattgcatatattgtgaaatataaaaaagtatatttgtatttgagaatatcatcaaaatttgagataacaaatgtggtttgcttttttgttttgtttgtttgtttgttttaaaaagtgctaacaaagcccattatcaacaacaaaggaatgatgcattgtgcttctggatatatattttggccttcagacacattggtaacaagataaatccctgagccctactcacaggaatcaaactgacagctacaggaatgttagtaaacttgtctatgataggcaattcctagggatttacatcttggttctagaccttaactgagaaattcttgcattttccagcttggcttttacatctatgggtttctcaaaaaacctcaccaatgctggttcattcaacagcgatgcaagaatctgttcaaatgcaaatgaccactgaggttcctccctaaaggaacaaggatctttctccaagtggctccctgttttttcctcactgggtcctccagaaccacagacagtaccagagaatcctttggctgatgatgtagggctatgtagtttccttccaacttcttccatcctgagtaaaaggctggttacaacagcaatggcttgatataatgattcttcttcagggtcctcatgaaataagttatagagggtctttgaaaactgaataaactgagactagaagacacaagttgaaaatatcacgtttgaatattagacttagcaaatataaagagaacttagaagtgaatagtctcctatataggatttgtaccatagaagcttcaccctagaagttataagaactggtgattaaccccaaaatacatattggttctagaaaggtgagtatgggccaggcgcggtggcacatgcctgtaatcccagcactttgggaggccgaggcgggtggatcatctggggtcaggagttcgagaccagcctggccaacgtggtgaaacctctactaaaaatacaaaaaattagctgggcgtggtggcaggcacctgtaatcccagctacttgggaggctgaggcaggagaatcgcctgaaccatggaggcagaggttgcagtgagccgagatcgtgccattgcactccagcctgggcaacaagagagaaactccatcttaaaaaaaaagatgagtatgaaccatggaagaaaatttcatttaagtgctctcacttattgcctaatagtacattttatccagactaattcctggactgtttgcctgccagcattacttaaatgttaggtgctatttttttttccttagacaaggccttgctgtgttgtccaggcttgagtaccatggtgcaatcatagctcactgcagcttccaactgctgggctcaagtgatcctcacacctcagcttcccaagtagctaggactataggcacatgccaccatgcctggctaattttcacattttttgtagagacaggatcttactatgttgcctgggctgatctcaaactcctagcctcaagtgctcctctcctactttggcctcccaaagcactcagattacaggcatgagccactgcgcctggccaggtggtacttctaattaggcaaagtccctttgaagctgtcctcagagggtgaacaagaattctggacagaaatatagttaaaattatgcataaattaggctgcactttgacctgcttccatggaatgaaaagtcactgacattagaatcataggcttttgtttaagaattgtttaagatgtttaatcctgaattccatatatatatatatatatatatatatatatataaatatttttctgggttcctagttcacaactcccatagtcctttgttacagtcttttcttcccttcccttctctcccctttccctccccttccccttccttccccctccccctcccctccccttccttctttctttttgacagagtttcgctcttgtcacccaggcttgagtgcagtggtgaaatctcagctcacccaggttggagtgcaatggttaaatctcagctcgcccaggctggagtgcaatggtgcagtctcggctcactgcaaccaccacctcccaggttcaagtgattctcctgcctcatcctccagagtagctttctgatagtcggtcttaaaaccctccctagaaagggtcttacctcatacccttaggggaaggaatgctgacatcatgaagcttccataaaaacccaagataactgggttcagggagcttctgatagctgaatgcatggaggctgacaggaggaaggtaaagaagaactcatcctcatgccgggagggtggtgcaccccaactccacgtggagagaagctcctgcgcttgggacccttccagacctcgccctgtgtatctcttcttctggctgtttatttgtattctttaaaatatccttcttagtaaaccagtaaatataactatttctctgagttctgtaagtctctctgtagcaaattaatcgaactcaaagaagggatagtgggaaccccaacttgaagttggtcagccagaagttcaggaggctcagacttgttactgggggaaaggagggagcagtcttggggactgaacactcaacctgtgggatctcatactatttctaggtagatagtgttggaatttaattggaggacactcagctggtatctgctgcttggttggggggaaaacccccacacatttggccacagacattttcttctatgttgatgattgttattgtcatggtgtgagagtagaggaaaaaaggcagtttgagagaatttttccctaaacaatagtactgttcatttatagtaattctagaataaatatgtcatactgactcattttagaaagtacttattcaattgtcaaatgatatagtccactgagaaatatgaagttatttgatagttttcattttggtaaagttctcgggatcctcagtatctgtactaaccagattttaattacaaaaagaagaacatattttgattaggcagtgtataagaaagagatgaacttaaaattatgttcagatataagatcagtaggaaccagggtgtgacccatctcagtaatttatcattcccagtacctagcattgggtttggtatctggtatacagtaaacaaatgtttactgaataaatgaacatttccaataaagttggaaatatactacacatactttttttctataggtacatgtcacagcagaagaattctctgaaacactggacacatttgagtgttaaaaataaaaaaatcattaaaaaatttcttcccactcttccatgctcatctgaaacttagagagctaatagatagattatttaactattttgggaatagcatgttagctattttagaggttacacccacatccatacaaaaaagcaagaacttagaattttctttttaaaaatgctatacctgattcattcttggtaaatccttaatgttttcttcttttttgaaaagctcatcttgccattgacttagatatgcttgaatatcaattttccctttgcctgaagaaagggagtaaaaccatttcataaggaacagcccactatactttcccaaaattcaaaaataataattatgattaaaaggtatttcactgagatataagatcccatttttttaatccaggaaatgatctgaaattacctttcatttcacccactggctctcagaatacttttcccatttctgtttagactaaaacgtttactttaggaaagttgggaactagggaatatgtggcgagagagggagaaaggacatatttagattaaaacaatacaccccgacttaataatgcaaattttatgtagtcattctcatgtatactattaagtttaaaacagcttctatattatgttcttaatatgcatatattgttccaaagtgggctgggcacggtggctcacgcctgtaatcccagggctttgggaggccgaggtgggcagatcacctgaggccaggagttcgagatcagcctggccaacatggtgaaaccctgtctctactaaaaatatgaaaattagccgggtgtggtggtgggcgcctgtagtcccagctactcgggatgctgaggcaggagaatggcttgaatccaggaggcagaggttgcagtgagctgagatcatgccactgcactccagcctgggcgacagagcaagactccatctcaaaacaaacaaaacaaagtggtctttagtagctctttttcaaaaatttgaaacactacttattcattcaaagagtttaagatacaaatgtactgacattaaaagatgtccatgatatactgcaaaatccaaaaaggaaattataaaacagtacttatggaatatttttttaaaaaagagagatgtctgcatatattgtgtatacataggaatagatctgaaaaggatatagacaaaaatgttttcgggtagggttgagtgaagacaaaaggacttatgtactgtctgaatttcttttctaagaattatctattacttttgtaattaaaaacaaatcttttaaaaataataaaattaaatgaatatgggtcatttactatcatattttctataatttctgagacatcaatagcctttaaaaggaatccaccttttccccctttgtagctatccttatttacataaaaataactaaataaattaaatgataactcctagatcatagtacctttttcagggctgtgttttgctgattctgcttccttctcatttgcaggcttggaaactataagaaaagatgtaattgcattctgtaagatgtttaacaaatactctttgaaagcaaaataatgtttcatatagacgtataagcacattattttattcaattctgcaaacaaattttagctgacttgacctatcatcagaagacaaaatattccaaaactttcacagtaaaaagaacattgggggaaaatccgtattttaaaaaatcttagaaggaagcataccaaatattaagtatttatttctgggtggtattttcttctttgtgactttctttaaataaagttatattacttttattatcaggagaaaaaaagcacatactggacgtcagaagagtgtgctacaaagccctgactgtggcaacaactcactgtgaaaccttgcacaagtcacttctctctgggccttagtgcctttatctataaaaggaagagacttgactagatgatttgtaaggtcccttcaaacttaatgttcaaacactttaacatataataaccacaaatatacattaatcagggttcatccctctataggacattgaatatttatgaaaataaactaaaggacacaaaaataaactcatatcactttaaattttgtcttggagacagactcatccctgtctcctacacctacagtgatttataataagtattcactgtttgaaaaatagctatggcctttaatcatcaaagattctattgtattttatcaaggcatgaaaatggtctaatacattttagaaatttctgcaacgtaagtagaaacaaaatacattattgagtctccaataagcaagaaattccacaaatcaaagcaccaaaatgcaatttggttaaccggtcaaacatttatggaccatgctaagtgctgtggtaatacaaaagaagtataagttaaaatgaagcccaattttagttgggtaaagtatatctaagtcagcaagatctttatgggtggctaatcatcaaaacagttaacattttaaacaggtatttaccatgcagctgactgaaataaagtaattcttccttggaaagttcatctccttttgaagcatccttagatttcacttcagtgtaagctgaaaacatataaataacccaaattacatttattaacaaccaggggcagagatgaggttcataatgggtcaggtatatctgggaactgggtgttaaagagtttctgtataagaaagatgtaagtgaagaaatacagaagtggttctactctactgtaatatatagtaattatactgtaatatatgtaatatatataaaatatagtaaatacaagaagtagttgatcattttgagttctatttttttcctacttgtttttttaatggttttccaagagctattaaaagttgaaattgtttaaatctggcatttagaaatctctgaaaatgtgacctcagccatttaaaaaacatcctcaataataaggaaaacagaaagttgggtgctttggtttacttcctacttgtgctttaacaggtacataatgtttttcctatttttttatccctctgttaaaagcatagttgatgacaatattaaacattctaacagtagcctgatttgacaatggaaactccttttataattaaatttttaggtgatttgtcttttgcttttaatgatgtgtttgtgatttgagtgtgtgaagggttaaagatggcctttaccttgttggtgtggtaaagaatgtttcccggctatcctgagaaaagctgaaaagggatcccaggtgtagctttaaacaaattatgaggtgctgtttgtttttgtgaactaccccatctcggctaaaaggtactttttgcaatgctccttcagtttaaagcctaagactgttttcacaaagtagggatcaggctttggcaaggcatcctcttcaggtcagtgggaaaaacaagtaaactgaatggtgtggtaattttgaggtagtacggaagaatataaagaaatgtgagctttggagtcagacttcagtttgctatgcaatttattagcgatgtgatctttggcaaatttttatctttccagctctcagtttccttatcatcaaaattggaaggataatgccacctatcatggatattatgagaattaaattttaaaaatgcatgtaaagttaatgtcttgacagagcaggtgcttaataaatgatagcgtttattgtgcttcctttttaaaatatttaatatccctgcttccttgtcccatttttctgaataatttgtagtatttcgcaggtttggcagtttgtctaaagttaatttccactctaatgacaacaacaacaattcaacattataccaacaatcaaatgatatgtgattcttatatacaaactacttatcattaaattgactactaacaggaaggaaacttgtgggcccatatgttacacagaatctcttccatagaagatcactgtatctatatcagcaaaaagtagtcataatataatttgagggccacagtgaagcaacgatcttatatcatgttgaaaattagtttagttgttaaaaaaatctgtaattatacttgctaaaatggaataaattcctgctgtacatcgttaaagactggtaaactcttacctggaggaatatgtagcttaaaaagcagcttaagcttctcagtaaaacttccattgtacattatgtctgttcaataaaattcaattgtaaataatcatgtatctaaagaacattcaatcaatttcagcaacaaagattaattaagatatagacattagtcaaaaattaggatttagaaacctgttacttaagctaacaattaaacaaccacctagtcaatcagatgctctccttcaagtgtataactgtataagcaaaatactctttatcaaaaaagtaaaatgttctctttcctagctccttccccccaatctcagatttctcttttcttttgaatgaggcctgtgcaggagagaactgttcttcaaggggtgatccctgataagaaagcatgctggggtatctggaaaagcaaatgaacaatatctacaggtacaacatcttgactatctgtaggtacaacatgtttgctgggtatttatctaccactcttctaggctatgtggttgaatttttacggggaggtcggtggggtgggggaagtccttcggtagtacccatgcatctgagtgtgggaaaattgggacgttatcttccttatgttaacccttaaaacactcacatctaacagcttgcttttctgaaagggttggggaaaataatatcaaaatacttagatttagcaacaaatgcagaaaagggtccatttattactaaagctaaacacactgtaacccatggtgatataatctgactaaattggcaataataggcagtactaagtatttctaggagcaccttttttttttgcttaaaaaaatcatcttaccaattgcagaggagaattctttgaagtttataaggcaatcagagttttcatctaacaatctgaatgtccataaagctagtgagtctttatttgcagaatgagcccagggactcaacaagtgatacaacgctctgaactgctggcagtcaatctgatactgttccaaatatggcagactggggtcatgatgcttcaatactgggcaacccaaacaccaataacaagataaaaacagctctttctattaaaaataaataaaaaaggaaagttactaattagaaaaagtaattttggaagattttaaaaaccatgtctgctaaaataaagataaaaataattagaatggctgtgatacaattctgctaaaaaaaagcattatttttcatttaaagaagaacaacagtaccttaaagatgacataaagttcatccaattcttgaaggctcaatttcacatcttgtgatacaacacgcaactttaaaaagattaaaagcaatttagtacacagattttaacattgcagtaaagaaattctctttgaattaccttagagtctctctctgctagaagaaaatatttgtgttttaacttcttaaatgaataataaaaagttattataagttattatattataaagttattatctatttttccttttaaaaagtagtagtagactagttcaattctactctaatatgtactttgatattcatctcttcatactcagaaatcactgccaaagaacagccacttaatgtctataaatataagtaacagtattctaagtcctattccatatattcctctcttgccacataagcagcatatctagtcatcatgtgaggttgctattaaatacttcaaaggcattgggagatgtacattccctctctatgccaaaaaacataatccaagaagtaataagcttagaaaatatgtacttttatcctattccatgaagaagaaggactaatgatacaatcattatgatatctaagaaatttgaaagcaaaggtaaagaaaaaagctagaattgatgaaatacagaaaattaaaaaaacccggtagactcagtaaataaaattaagagttggtttattgaaaaaatcaataagatagacacatttctggcaagtgagatgaaagaaatcacaaatgactatcatcgagaagtggataatttaagcatggatacagaagtcatttaaagtgcccagcagaggaatggtggctcatgcctgtaatcccagcacttgggaggccaaggcaggcagatcacttgaggccaggagttcaagaccagcctggccaacttggtgaaaccctgtctctactaaaaatacaaaaattagccaggtgtggtggcgtatgcctataatcgcagctactcaggagactgaggcacaagaatcacttgaacccgggaggcagaggttgcagtgagccgagatcatgccactgtattccagcctgggcgacagagtgagactgtctcaaaaaaaaaaaaaaaaaaaaaaaaaaggtgcccagcatgggaggggccaatatgacaaactagaagcagatcatgggtgctgctctcttatggaggggaaacaaagggtttagtgaacactgaccctaaaagccaatcatctaagaaaccacactgggaaccatcaaagcagcaaggggacacagagagcagagaggagggaagctgggcagcagcctatctggcatcaatgcggagtcaggagaagctccccaatacgggagagggtaattcacactctccatggggatctgtgtaaggctgggagtgggagaattcccctgccctaaccccctacttgccactctcatcctcccacctcacctctaaactgaggcagagagccacccagacggtttgcagaggcaactcttaagtccaaggggacctctacaagcctcggatcctggaacagaccaacaccagcgccacagccccaatagaggccaaagtcatggtgcctgggagcagtaggattggtccaccctcctcaccagacaaggcttggtgccagcttccagcccagcactaccgcttctgcctgaaatcggccagaggctgcagcctcctgttgtcccatgaaacacctacacggcagggcggacgaccccacctgctcctgtcactggtagccaggcgagcaacacctgctggagcttccagcccagatgtcccgcttctgcctgaacttagccagtggctgcaacatcctgttgtcactggaaacacccaacaggcagggcaggtgaccccaccacgctccaccactggtagccaggtgggcaatgcctgttagagcttccagtccagtggtccagcttctgcctaaactctgctggcagttgcaacccctggtaccctcaggatgcacttggacagcagattaggtgacactactcactcccgcagctcccagttgggcgggactttctgacttaggtggtgcccaagcatcactgagagatgagacacccaggttcgcagcttgatagaggggtggtgtgtgcctccctccacagggccgacccagtaaggataagacctgtttgccaactgtggctcctacctgagggagccctgtggaccagagcacccaacaaaagaaatgcgggcatgaagccagtaatcagaaggggttcctccaaggcccaggggtggactaggtgaatgggccatctccctgtccccattcacagaccattaccctggagccatgcagcagagcaagaagctatctgctggctaacactcttaagcgccacctactggatcgcagcccaaaagacaacactaaaatattctgccagtatacaccacctgtgaaaactaaggtaaaggctcctacgagcacccagcctgagccaatgcatgtgtatgctgccacgctgccacggatgctggcatgcacgagcaagcatggattccaccgccaccaccccgactaagtgttttggctagcacctccattgtagtgttgaggccagtggactgggaacaccttggcctctctggcagagcaggttcctagccccgagggcccagagaacaaagctgggggtctggtaccagccccgcagaggtagcacactcatctcaggagagctcaggtgagccttggccatctgaaatcttcaaaatcaaagccagtcaactgaatccacaatcaaacccccaagggcatcaaagaagataaaagcaaaaaaaaaaaaaaaaaaaaaaaaaacaaaaaaaaacccatccaaaggaaaacaacttcagagattaaaggaatatcagctcacgcagatgagaaagaaccagcacaagaactctggcaactcaaaaaaccagagtgtcaccttacctccaaacaactgcactagttccccagcagtggttcttagccaggctgaaatggctgaaatgacagacatataattcagaatctacatagaaatgaagatcattgagattcaggagaatgttgaaacccaatccaaggaatctaaggaatacaataaaaggatacaagaggtgaaagacaaaatgaccattttaagaaagaatcaaactgatctgatagggctgaaaaacttactacaagaatttcataatactatcacaagcattaacaacagaatagaccaagctgaggaaggaatctcagaactcgaagactggttctctgaattaacttagacaaaaataaatgaacatttccccaactttgctagacaggacaacattaaattctggaaatgcagagaacccctgcaagatactatataagattaccatccccaagccacacagtcatcagattctccaaggtcaacatgaaagaaaaaatattaaaggcagctagagataaggagcaggtcacctaaaaaggaaatcccattagcctaacagtgtactattcagcagaaatgctacaagccaaaaaagattgaaggcctatattcagcattcttaaagaaaagaaactccagccaataatttcgtattcagccaaactaagcttcataagcaaaggagaaataagatccttctcagacaagcaagtgctaagggaattcatgttcattagatctgccttacaagagatcttgaaaggagtgctaaatatggaaaggaaagacgattatcagccactacaaaaacacacttaagtacatagactattgacacaataaagcaactacacaatcagttttgcataataatcagctaacaacatgatatcaggatcaaatctacacatattaatattaaccttgaatgtaaacaggctaaccagaatgtaactagactgccctaattaaaaggcacagagtggcaagttggataagatagtgagatgcaactgaatgatgtcttcaagagacctatctcacatgcaatgacatccaaaggctcaaagtaaaaggttgaggaagaatctaccaagcaaatggaaaacagaaaaaagcagggcttgctattctgatttcagacaaaacagactttaggccaacaacaacaacaaaacaaaacaaaaaaggaattatataatggtaaaggattcaagtcaacaagaagacatctatcttaaatatatatgcagtcaacacaggagcactcagattcatgaaacaggttcttagaggcctataaagagacttagataactacacaataatagtgggggacttcaacaccccactgacagtattagtcatatcatcaaggcagaaaactaacaaagatattcgggacctgaactcaacacttgaccaaacggacctaacagatatctacagaacttttccccccaaaacaacagaacatattcttctcgtctgcacatggcacatactctaaaattaaccacacaatcagacataaaacaatcctcagcaaattcaaaaaacccaaaatcataacaactatactctttggaccatagcataataaaaatgaaaataaatactaagaagattgctcaaaaccatataatcacataaaaattaaacaatctgctcctgaatgacttttgggtaagcaatgaaactaaggaataaatcaagaaatatttaaaactaatgagaataaagatacaacatatcagaatctctggtacacagttaaagcagtgttaagaaggaagtttacagcataaatgcttacataaaaaagttagaaagatctgaaattaacaacctaacatcacacctagaggaactaggaaaacaagaacaaaccaatcccaaagctagcagaagacaagaaattaccaaaatcagagctgatctgaatgaaatcaagacatgaaaacccatacaaaagatcaatgaatccatgagttggctatttaaaagaataaataagactgatagaccactagctaaactaacaaagaaaaaagagacgatacaaatagacacaatcagaaatgacaaagagacattaccactgaccccacagaaatacaaaaaataccctcagagactactatgaacacctctatgtacacaaactagaaaacctagaagaaatgataaattcctggaaacacacaacttgccaagattggaccaggaagaaattgaaaccctgaacagaccaaaaacaagttctaaaattgaatcagaaacacacacacacacacacacacacacacacacacacacacacacaccaatcataaaaagcccagtaccagatggattcacagccaaattctaccagacatataaagaagagctggtaccattcctactgaaactattgcaaaaaattgaggagaaatgactcctccttaacgcattcttttaggccagtgtcattctgctaccaataactggcagagacacaacaaaaaaaagagaaaacttcaggccaatatccttgaggagaacagatgcaaaaatcctcaacaaactactagcaaaccaaatctagcagcacatcaaaatgctaacacaccatgagcaagtatgctttatccctgggatacaaggttggttcaacatacacaaatcaattaatgcaattcatcacaaaaacgaactaaaacaaaaaccacacgatcgtctcaatagatgcagaaaaagctttcagtaagattcaacatcacttcgtgttaaaaagcctcaacaaactaggcattgaagaactgtatctcaaaataataagagccatttatgacaaatccacaaccaaaatcatactgaatgggtaaaagctggaagcattccccttgagaaccagaagacaaggatgcccactctcaccactctggttcaacatagtacagacagtcctagcccgaacaatcaggcaagagaaagaaataaaaggcatccaaataggaagagaggaagtcaaactatttctatttgcagatgatatgattctatatgtagaaaaccccaaagtctcagcccaaaagctcctagatttagtaaacaactttggcaaagtttcagaatacaaaaatcagtagcatttctatgtaccaacaaagtccaagctgagagccaaatcaagaactcaatcctactcacaatagccaaaaaaagagtaaaatacctaggaatacagctaactatggaggtgaaaggtctctacaatggggattacaaaacatttctcaaagaaatcagaggtgacacaagcaaatgaaaaacattccattctcatggataggaagaatcaatattgttaaaaaggccataccaaccaaagcaatttaaagattcagtgctattcctatcaaactaccaatgacattcttcacagaattagaaaaaactattctagaaaattcatatggaaccagaaaggagcccaaatagccaaagcaatactaagcaaaatgaacaaagctagaggtatcacgttattcaccttcaaactatactacaaggctacagtaaccaaaacagcatggtacaggtacaaaaacacacatagtctaacggaacagaatggagtgcccagaaataaagctgcacacctataaccatctgatctttaacaaagtcaacaataacaagcaatggggaaaggacaacctattcaataaatggtgctgggataactggctaaccacaggtagaagattgaaactagatccctaccttccaccatatacaaaaatcaactcaagatggattaaagacttaaatgtaaaacctacaactataaaaagccttgaagaaaacctagggagtaccattctagatataggcggtggcaaagatttcacaacaaaaatgccaaaagcaattgcaacaaaaataaaatttgacaaatgggactaattaaactaaggagcatttgcacagtaaaactatcaacagagtaaacagacaacctacagagtgggaaaaaatatttgcaaactatgcatctgacaaaggtctaatatccagaatccataggaagttaaaaaattaaaaaccaggccaggtgtggtggctcatgcctataatcccagcactttgggaggctgaggcgggtggatcacaaggtcaggagattgagaccatcctggctaatgtggtgaaaccccgtctctactaaaaatacaaaaaattagctgggcatggtggcggatgcctgtagttccagctattcaggaggctgaggcaggagaatggcgtgaacctgggaggcggagcttgcagtgagccaagatcgcaccactgcactccagcctgggtgacacagcaagactctgtctcaaaacaaaaacaaaaaacaaaacccaaaaatcaaacaactccataaaaaagtgggcaaaggacatggacagacacttttcaaaagaagacctacatgcagccaacaagcacatgatcaacatcactaaatattagagaaatgcaaatcaaaatcacaatgagataccgtctcacacaatcagaatgatgattattaaaaagtcaaaaaataacaagatgctggtgaggttgtggagtaaagggaatgctaatacactgctggtggaaatgtaaattaagtcagccactgtggaaagcagtttgaagatatcacaaagaacttaacagagaactaccattcaactcagaaatcccattactgggcatatacctaaaggaatataaattattctaccataaagacacatgtatgtgtatgtatgtcacagcattatttgcaatagcaaagacatggaatcaacttagatgcccatcaacagtagactggataaagaaaatgtggtcaatatacaccatggaatattatgcagccataaaaaagaataatattatgttctttggagcaacatggatggagctggagaccgttatcctaagtgaactaacagaggaaaagaaaaccaaatactgcatgttctcacttataagtgggagctaaacattgagtacacatggacacaaagagggaaacaatagaaacaggggcctacatgagtatggagggtgggaggagggtgaagatcaaaaaactacctattgagtaccattattacctgtgtgatgagataatctgtacacgaaaccctgtgacacataatttacctatataacaaacctgcggctgggtgtggtggccatgcctgcaaacccagcacttcgggaggctgaggcgggtggatcacctgaggtcaggagtttgagaccagcctagtcaacatggtgaaatcccatctctactaaaaatacaaaaattagctgggcatggtgacaggcacctgtaatcccagctactcgggaggctgaggcaggagaattgcttgaacccaggaggtggaggttacagtgagcagagattgtgccactgcactccagcctgggcgacagtgagactcagtctcaaaaaaaacaaaaagaataagacaaagaagcctgcttctactgctattattcaataattctctgaagatcctacttaatgcaataacacagaaaaaagaaaagaggtataaatgttaggaagggtcaaaattctaagactggaaatgacatgcttgtctattcagaaaattcgaggtcaactaaaaaaaatagtacaattaatgagagtcaataatgcgaccacttagaaaagcaacatacccaaatcaataacttttacacacacagccaataaagaattaggcaatgtaaaggaaaaatgatctcattcatattagcagcaaaaccataaaatatataggggtagaataaacccaataagaaatgtgtaagacctagatgatgaaaattaaaatgcttactaaagaacatttaaaaagacagactgttaaaatgaataaaagccttaccagatttcaaagtagacaaactatggtaattgaaagagtgtggtactgttgtagtaacaaaaaaagagagtccaaaaataaagcccatgtatgtatataagaatttagcatatgaagaaagtagagtactgtgaggataaactatttaataattggtttttagaaaatgagtgattttggttggaaaaacataatattacataataaaaaaatatactctaggtatattaaagttctaaatgttaaaaaagcaataccagtactataggccaatatgaaaaaatatttttataatttatataattttaaatagggaaagcctgctaagtttgatatgaaacccagatatcatgtaataaaaaagagaaagacttcaagaaaatttgtaacttgtataatctgaaagacattataaagataatgaaagaaataataagactaggggaaaatattaggccacaaatatagctgacaaagaactggtactactaatagtcaaaagagcttctacaaatcaatacttaagacaatctcatagaaaaataagcaaaggctatgaataggcaattaagagaagaaattaaaaaggctaataaacatatgtgatcagtgaattgaaaccttaaaagtatttgatctatcacattggcacaaattgaagattttgttttgttttgtttgttttagagacaaggtctagctctgttgcccaggctggagtgcagtggcatgattatagcttactgtagcctggaactcccaggctcaaggtgatcctcccgtcgcagcttcctgagtagctgggactacgagtgtgtgccaccatgcctggccaacaaattcaagattttaaatatctggtgttagtgagaatgtggggaaaggggcattcttacaggctgctggtgggattacaatttggcaaaatcttttgaagcataatttggcagggacctgtcaaattttaaatgggcatacccttttacccagcttccacttccagatatctatcttgcaaagaatagatatacaagaatgtttacataaagtattatttgtaagagcaaaaaagggagacatattaaatgtacatcagcagtgaataaattatagcatatccatattatggcatactattcaatgcattaggaagagtgaggtagatctatatttactgatattcaataaccatgatctatttctgaatgaaaaaagttgcagagcaaagtgactggtatgatctcatttcaaaaactatatccttccaatacacatgcatgtgtgcagacacctagataaaagatctgaaaggatatatgccaaattattttaagatggttacttctggggtggggaatctactttttacatttatgtaatgcttaaattatttacagtgagcatgtattacttcagtaaatttttaaaaatgctaacatataaaaactaaaacaaggggccctatgctaactatgtcacagtaacctcactgaattattcaattgaaatctaaacctggaatcttcagaaacattaatcttcccagatttgtatctctgaggaccttggcctttaagcaagtaggtttacaaaaacaacacatggtcatgataaaagctcaaacagtacagaagaatataaacagcaaagtaaaactctcctccttctgaccagcaatctattaatccgattcaccaaaggcaaccaatattaacagttgcttatggagccatccaaatattaaaaagacaagtatttaaaacatagtatttactttaggtatccaaggataataatattcattggagcactgactactatgtagatcggctgttcttactgatgcagcacatcacaaatatgttatgcttaaatgccaacatgatagcattcaacactgagctgcaggctaggtgtggtagctcacgcctgtaatcctaaccctttgggaggcctaggcaaggaggatctcttgagcccatgggtttgagacagcctgggaaacatactgagaccctatctctaaaaaaaaaatttaaaaattagccaggcatggtggtgtgtgcatgtagtcccagctcctcggtaggctgaggaagaaggatctcttgagcccatgaggtagaggctacagtgagctgcgatcatgccactgcactccagcctgggcaacagaacgagaccctgtctcagtggtcttgaaggtcaaatagtacaaaacatgttggagaaagcaacataattcaaccagaagaaaataatgtattttctctaaaaaagaatttaccatagggtaaaccttggcaaggatctagctcaaaagtttagtccttttcattttattcgcccagaagataatttctaaagaaagttatagaaaaaaaaaattactccaactggtttttcctcattggttgcatacttaccacattctgttttgttgtttcctctagggtctgtatcacatacaacctatttcgacagcgcatactatgtatatcttcatagcgaatattaccatatttctgcaagagatatgatttcagtggctactcactcataataaacatccactttttcttttacaattcagttttatcagactgaattcttggaggccttgattctatttctagggaatttcctgacttgttcaatgattttgcaaatttttacctcccacgtttcagtttttaaatatattcactggagagaattccatctactatgtgaatagactaagtacaaaaatataggtaaaattcttaatctctaagaagtgaataataataatgagaataattcaccttttaatccagtgatagatgtttaaagtggtcattatttgtgaaagcaagtgaatttaatttcatttaatgaaaaacaaattgaggcagaggaggttacacaacctagaacagttcacagaactcattttaaaagttaagttggattttaagttgtatgtctacttgcattattatcttacacttaatataccattagagatagaccatagttcaatcattttaaatatgctagctaatatatttatggcatgaaaaaacttacctcatttgattctctaatcaaatctgtaatatccactctagtatgactggttttttcatcactcacatttgaaccttgctgaacatttgaaggcaatggactatccttattagtgacattgtcaaagaacctattgaaaagtgatagtaatacaagaattagtggaactaccattattaaagcagagaaatgacacataatttctccctagttagttagaggttactttcaactgagaggacaagggaaggtcttatgaagaagtggaactttgttgctgtttgcagatgacatgattgtatatctagaaaaccccatcgtctcagcccaaaatctcctcaagctgataagcaacttcagcaaagtctcaggatacaaaatcaatgtacaaaaatcacaagcattcttatacaccaataacagacaaacagagagccaaatcatgagtgaactcccatttacaattgcttcaaagagaataaaatacctaggaatccaacttacaagggatgtgaaggacctcttcaaggagaactacaaaccactgctcaaggaaataaaagaggatacaaacaaatagaagaacattccatgctcataggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaaggcaaaagaacaaagctggaggcatcatgctacctgacttcaaactatactaccaggctacagggctacagtaacaaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattacagacttacatgttagacctaaaaccataaaaaccctagaagaaaacctaggcaataccattcaggacataggcatgtgcaagcacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtactggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggattataaatcatgctgctataaagacacatgcacacatatgtttatagcggcactattcacaatagcaaagagttggaaccaccccaaatgtccaacaacgatagactggattaagaaaatgtggcacatgtacaccatggaatactatgcagccataaaaaatgatgagttcatgtcctttgtagggacatggatgaaactggaaaccatcattctcagcaaaatatcgcaaggacaaaaaatgaaacatcgcatgttctcactcataggtgggaattgagcaatgagaacacatggacacaggaaggggaacatcacacactggggactgttgtggggtgggggaggggagagggatagcattaggagatatacctaatgttaaatgatgagttaatgggtgcagcacaccaacatggcacatgtatacatatgtaacaaacctgcacgttgtgcacatgtaccctaaaacttaaagtataataataacaaaaaaagaagtggaacttgttttttgtttttgagatggagtcttgatctgtcatccaggctggaatgcaatggcacaatcttggctcactacaacctccgcctcctgatttcaaacaattattctgcctcggcctcccaagtagctgggattacaggtgttcaccaccacgcctggctaatttttgtatttttagtcgagacgaggttttgccatgttggccaggctggtcttgaactcctgacctcaggtgatccacctgcctcggcctccgaaagtgctgggattacaggcatgagccaccgcacccggtcaagaagtggagtttgaagatggttgagcattaggagggcatgggtgagggaaatgggatagtgtaggaatcattttggggttttgaaggaagcaaacaggctcagagagtacttggcaaataccacacagctcagtaagagtggaatatagggtatgtagaagcatatagggggaaataagtgaagaaaggtacactgagcccttaccacagagttctgaatgccagagtaagatgtttgtattttattctgtacataatgggatttcatgtggcattatgatagttgcccactcaaatttattcatttagcatatacaaatgtgtgcatatacacatacacacacatacaacacatgtgctccaatacaaaatagcattcatacagaagctactaggaaaataaagttcaacccacctgaaaccacatagaaaccagaataacttcccggccactggatatttaacattatcaactatgcttttcctgcttgaactaattctacatagacactttatagctcaaactgggaatatgaaagtcctagcatactgaatcaacaatattagtgtaaatgtgtacataatttagtggttcacttcaaagtgatttattcttgctatattttttctggagatagaggactggactttaggtgtagctctttcattcaagtggttttgtaatctcggacaaactgaaatttctagggctcagtttcctctgtaaaataggggattgaacaacatcatctctcaaatctcctccagatttaaatgttatggttcttacaatacctgtttaaggctgtcacagcttcagcatcatctttacaagtcagcagtttgtctaaattatagtcaagtattgccaatcccagttgcaaaatggcctttattccatcatagaagaaacagtccaccacattcactgcactttcaataggtagcacactaataaaaagtgtgagaaaccaagagagagaaactgaggaaaagaatgtcatatcagtcatgtgttctgtcagctgaggaaggtgatccctgataagttcttcaaagactgcctgatccaccaaggcacctacagaatatcaaaagaagtttaaaaataaacatttttcaaaaggacttgtttccatacctccccacttctattagcatgctgatgtatctcattcttcttccttaaattatgaactctttcagaacctcttctgtattttatacatctaactgctagtagtgtcatgtacttcagaaacacaattcaaattcatttgaagagttatttattgagtctttattatatgcagagacctgtactaggtattataagagctataccaattaatgaaatagtctcatgttcagggagtttaatatctagcataacacaagataaatacacaaataattagaattcttcactcttgacaatgccaaacaacaaagttctctaagttcattttgattatcaaaaatttattctgaatttaacacttcagaaatgaatcagtgacatgagagtcacactttcagactccagcaatacacagagaaagcactgatccctctgatgagttctcagctatcaatcaagagaagccagggccttctaattggttaccctctgctttgcccaataaggcatccacttatatcctggtcaagctttgaggaaaactcatcttctgtctcagagttcatttcctccttgatgggagaatttggggaataggagtaagtagtagaaaattggagaaagagcatgccaggtgctaccccagattttcctttttctacttctccccaataacacattgtccttggattcttactagtggcataaaatcatctgaacctaaaaaaaaaaaaaaaaaaaaaatacacaaataattataatgaaagacagtaaaatcgatgacctaaccacaatcctgaaagcctattacggtacaaagagaccattcataagttttaaggtaagtggtcacagatctgtaaatatttgatgattaaagaaaatattggccaggcgcggtggctcacacctgtaatcccagcactttgggaggccgaggtgggtggatcacgaggtcaggagattgagaccatcctggctaacacggtgaaaccccgtctctactaaaaatacaaaaaaaaaaaaaattagccaggcgtggtggcgggtgcctgtagtcccagctactcgggaggctgaggcaggagaatggcgtgaacccaggaggtggagcttgcagtaagccgaggccgcactccagcctgggcgacagagcaagactccgtctcaataaaataaaataaaataaaataaaaattatacaattaacaaactaagaactcgatccttctttgaaatcttgcaaatatctatataattcatacaaatatggagattttaagcagattgaaatctccctcccatcaaaaaactacaaaaattcaccagtagctgtggatacttgagatcaccattgttttagcaacatagagtttataaacttaatgcttccatttttgttaagaaacagaccaggtattttatttttaaaagcaacatattaaacaatctttctgactatacattcagtacaaaaagctcttcttttgagaatgtcagtgaatgtgacattttgatattgcttgcattttataccacaacataatccatcagtccttctactttattagtaattagacaagagacactgaaattgtttagaaaggaaatatacatctctgtgtgtgtatgcatatgtgtgtgtgtggtttttcttttaccaataattcgacgattaaaataatcaggcaacattcgttcacatacagcaaccagaagccaaaaagcttcttcctcttttgcatatagaagcagcactgaagtcaaaatattcattgcctaaaattcatagaaaacagtattaaaaagcaaatattgctcaagtaataattatacttcttcaaacataatagtttttgacagcaacaagaacaactgagagtaataatagtgtaataacagtggaaacatgagaactctgagccagtccaaggcaaaacaaggtgaagtcaggctaacatttgataatcagttattttataaagtaacattcaagaaaagtgaagcagtaatataataaatacagaacataataagcaaaacctctctaatttcgaagagtgaaaaaccttaattatcactaatctgaaaaaagcctacataattttcaaagacatactaaaacgaaagaaaacgaacttcatctgtatttccaactacctataaagaaatagccctcagatatgaatcatcctcaattttgtccaaaactgaatatcttctttcccctatcaagtaggattcttcttacctatcctagttttgattatgctgaaaaccctctatctgctgcatctgtttcatatcctagagtttcttcttataaaacgtctttcggatttgctttttccttcccattcccactaccactctaacttgctgctgcttcttacctatcttgcatacaaatgtcagatcattacttttatatacattgccacatcccttattataaagtaataaatccttaatggatagaatttggagagaatggaaaagtatgaatgagaaaataaaacctcttgtatcctatgtacccagaaataaactgttaacaagttgatatatttttctgcagttttttcttcctttttctcctaaaatttgtatcacactgtgtactaaatctttatttttttgcttagcactatatagtaatattcaatgccactaaatattcttctaaaacagtatttttaatgactaaaaaaatctaaggtggatctaatataaattatttaaccattctactattgttggacatttaggttaattcaaattttttactattacatataatgctgcaatggttatcttttttatataaattttcatccaactatacttttttctcaggacacatacctagaaatgaaattgtttggtcacatggtatttttaaaagacttcatattattgccaaattaaattcctgaaagaaaataccaatttatatttctgaccaatagtgtttaaatgtttatttcactgcatctttgccaatattgtgaatcgtaataactataatcatctttattgatttgatagtgaaaaatggtagctcattgttttaattttaatttctttgaggttgaactttctttttcagactttaacatcaacctgtattttctcttctgtgattaatcctttcatgtccattgctcatttttatactttcatacctttcatatagatttgtatattaactatgccaatttcttgcctaatctagtacactgtttgatgtcaagcttagtttttactgaatcattttcccatgcaagaagccatactaggaggggatgtagtaaaaatggcagagtaagaacttctaaaaatgctctcctctataaaagcaacaagaacactgacaaaagtcatcggaatcaactttagaactctggaaattaaccaatagcttacagcaattcaggtagcatttatttaataaaatggctgaatctcagtaaaaccagtaagctctgtggcattttaaattgccctattcccacccccctccccagtttcacagtagccttaaaaaccaacatctaggccgggtgcggtggctcatgcctgtaatcctagcactttgggaggccgaggtgggtggatcacttgaggtcaggagttcataaccagcctggccgacatggtgaaacccagtatctactaaaaatacaataaagaaaaaatagcagggcatggtggtgcacacctgtaatcccagctactcgtgaggctgagacaggagaatcgcttgaacctgggaggtggaggttgcagtgagccaagatcatgccactgcactccagcctgggcaacagagtgagactctatcattaaaaaaaaaaaaaaaaaaaaaagagagagagagagaaaaaagaaagaaaccaacatctagcaattacagtggaaaccagtacctagtagctactgaatggaacagattggggttggaactccagcaaagccccattcccaaataattgttgttatttgacttgtctagtggttccctggaagactcctctcacaagactgtctttatttgacttgacacagagctcctctggtgtaaacagccttttcccctgtggtgtttgttgaaaacaatcagaggcagttgttgaacatgtggctatccaaggcagtggatagcagttgggccaaacaatacgctaacaaagtgttaaaagaaaagtgggggctttgaaaaactgtgacatattcctgggaacccagaaggccaactacatgcatatggctttatgtatactcacagttgtatgtattcttaggaaagaacagaaaagacctaagctcttatctccagctaatcttccagctttgtgcgagcagaaagtgataaagactagaaataattctaactgcaagaacaaaaaaccaaacaccgcatattctcactcataggtgggaattgaacaatgagaacacatggacacaggaaggggaacatcacactctggggactgttgtggggtggggggagggggaagggatagcattaggagatatacctaatgctaaatgatgagttaatgggtgcagcacaccagcatggcacatgtatacctatgtaactaacctgcacattgtgcacacgtaccctaaaacttaaaatataattaaaaaaaagactagaaatagagaaaaatcaacaaaagcaaaagttggttctttgaaaagattaaaaaagacaaaaaggataaaaaacatagaaatatttttaggtagcctaactaaaaaaattttccaaaaaaaaagagcaagaacgagatagtgcgagtgagagatcaagagtgcaaaagtgagagtgtgcaagagcaagagtgtgagaagggggactcaaattattatagccaggaaatagagaactatcaaccttatagaagtaaaaaagattataagtgattatgatgaaaaattatatgccaacaaattagataatctagataaaatggacgagtttctaaaaaaaaccacaaactactgaaactaaaatgggaaaagtgaaatagacctataataaataaagagattgacttagtaatgaaaaaactttccacaaagcaaactctaagagcagatggcttcactggcaaattctaccaaacatttagagaataattaccaccaattcttcataaactcttcaaaaaataggaaaggaggaaacgctatccaacttattctaagaaacctagacacccaaagtagacgaagacatcacaaaaaaactatatatcaatatatcttacaaatataagcataaaaatcctcaacaacatgctagcaaactgaacttaagaacacataaaaaggatcccaaaaggccaagtgggatttattctgggaaagcaaaagtgattcaacatataacaatccatcaatgtttatatatatgtgtgtgtgtgtatatatatatatgtttatatatatatgtttatatatatatatatatggaaaaaataacatgatcatctcaattgacacagaaaaatcatttgacaaaatcaatactccttcatgataaaaacactcaacaaactagcaatataagagaacttccgcaacctgataaagatgatctacaagaaacccacagttaacattatactttatggtgaaagactgattactccccttaagataaataacaagacagggacatgcattcttaccacttctattcaacattgtaccgaaggttctagcctggtcaactaggcaagaataagggaaaaaaagacatccatactggaataagagaagtaaaagtaacactattcagatgccatgattttgtatatagaaaatcctaattaatccacaaaaaaatctactagaactaataaataagcttagcaaacttacagaacacaagatcagttatcagttgtatttctatatgctggcaacaaacaatcaaaacatgaaatcaagaaaacaattcaatttactataataacaaaaaattaaaatacttagaaataaaattaacaaaggaagtacaagccttgaacactgaaaactataaaacatctttggatgagacagattaaagaatgattaaataaatgaaaaggaaagacatcttgtgtttatgggttggaagagttaatattgttaatatgaaatactcccgaaattgatctacagattcaatatgatgactatcaaaatcccagctgccttttttttttcttgtttgcagagattgacaagttgatcctaaaatttgtatggaaatacaaggaactaaaagagccaaaacaatcttagaaaagaacaaagttaaagaactcacacttcctgattgcaaaacttactacacagatgcagtaatcaagacaatgtggcactggtataagggtagaagtataaatcaatggaatagaattgagagtccagaaataaactctaacatttatggtcaactaattttcaacaagagtgccaaggcaccacttcacgctcaccggaatggctgcaatcaaaaagaaagacaattaagaagtgttgtcaaggatgtgcagaaattagaatccttgtacatacaatgaaggggagatttggtaaaaaaataaaataaaataaagacaaagaaaaaatagaaccctcatacattgctggagggaatataaaatggtgcagtctctttggaaaatagtttgacagtgcgccaaaatgttaaacagacagttatcatataacccagaaatttcacttcaagatatttacccacaagaataataaagcaatgtccataaaaaacttgtacatgaatattcatagcagcattattcacaacagccaaaacaagaaaacatctcaaataactattaacattgaataaacaaaatgtggtatatatccatataatggaatattattaaatcataagaaagaagtcctgatacatgctacaacatggatgaactttgaaaatgatatgctaagtaaaagaaggcaggcacaaaagatcacatattgtatcactcaatttatataaaatgtgcacaataggcatattcatagagctagaaagtagatcagtgattgcttgggttggtagtaggagaaatggggagtaactgctaatggatatggggcttctttttagggtgatgaaaatgttctggaattagataatggtgaaggtttgcacaactttgtgaatatatgagagaccactaaaggggtgacgtttgtggtaagtgaattatatatcaacattagatagatagatggagacagatgatagaaaagattagagagacagaatagatagatagatagatagatagatagatagatagatagatagatagatagagcaagctagccagccatgtgtctcacgtgggtttttgatcaaaaccaacaaaatctgtctaccatattaagtttaaattcttttcccaggcttgaaagattcttcatgatcttgtgccatacaaatttacttttttattccaatgtgaacctagccaatcttatctcccaaggtgggcttattctcacctgaatggtatcactcatactttagccccaaataactttcctcctgccctccatgtttctaactttgctctcatcttttagaagtcaatattaagtgctgcctattttgaagctatctctaaactactgcttatagacaatatcacagggtctgtgagtataagctctttgagaaaagaagcattatgcttcttttgtacctttcagagatcctaaaatatgctaaaaatccttgccatttagatgttccattcacttaaacagtttttcaaaaaaaaaaaatctctattgacaagttacagtggataggtagtattgacatgtaacaattacaggtattcaacccattataaataaacgtatggcacagagtgctacctatccatgacattccaatctcctcttcttccatagtagctgctcatgtctgctcagccacgctatactccacagacttccttgtgaataggtgtatccacgtgactaagatcatccaatagaatgtgcatgaagtgatatttgcccctttcaagcctagcccataaaatctttcacagttgtttctccatgctctttccctgttcctgtgagtgctaatggtgatgaaaatgtactcgggaaggtttgttttgaaaatgacagtctgctgtcagtctacagtctaagttcctgaataatctcatggaggagagctgcctactgacctgaagagtcaatctcctttgtttattccttcaagaaataaaattatactgtttcatctattatctgtgtttgtgttagcagtctagcctatcctaattgattgtgtgctcctaaataatttttttccaatgattcctccactgcctataaaataaaattcaaactccagctctatcccaatctaccttattgattttttttctccaactacttcacttcatccaccctatgtttctaccaaactaaacaaacatggtcctatacatactttacgtttacctctacctatgttcggttacatggattccatcacctggcatgttcttttcattccatttccatatgtccaaaattcaccaatttttaagacttgcaaatgctaccttttccacgaagccttctctgactcctccagatgaaaaatagtttctccttgttataaatcatgacaggaatttatatttctctaacagtttttctcacttgatttttgtttcttaatgaatatgctttaatgtctcctggtctacatacttttaagggaggacccttatctgatacatctttatatagccttaagtacctagcagagtatcttttatagagcagaagttcaataaacatttgttaagtgaaaaagaaaaataatgaaatatcaattctcctaagtattcccactaccatcctacttacattaatactatgctctatctatctcacccccatctctttccttataatcgccacttccaaattagtggaattggatttgatgtgattttatttggaacatacacacagttgggctcatagttaagtcatacctggcagtatccaattttgggattcctgtatgcataagctgtgagtacccttctcagagcagatatgccagtatcactctgaaaggctgggtgctcaggcagagagcgacgtaaatcacgttcaatttcttcagtagccaagttgcaggtccctaaggactgctcaaccacttcagtataatagtcaggattagtagccatgtcattaacagcacctgtgaagattattacattaacatacaacagaaggtggatataatgaagctatttccatatatacataaataattggatttcattaccttgatatttagccttatgcttaagtgatttctgagcacaaacagaaaagagctttacactagaatctatgtcaagctactaatttatccaacagaataccaatttcatgagcttttttcccccttaactgactgttgacactaaagattcccccagtatacatatcttgcctaataaactaatgtgctcagatgctggatgtgtggatagataggtaaggtatagataactacttacctttctttctttgactagtccgaactcaagatgagtaagactttgtattaaccatctttgtaattcttttgctttagcttagggcataactcctagaaaggcatagttaatgtctattaaataaatacaatgaataaacgtaatacctgaaaaaagcatccagagttctcctcttaatgtttctggaatccctcttacaacaagatctcgagtctttttggttcgaaacatactaacaccacgtccacattctgcaaacagtattttccatgactgttccttcattttttctttcaactgtaatgacagaaaaatcaaaacaactaaatttagtgagaaattaacttctgcaaaataactttcccactctctttaccttgaaacaacatctatagaaattaagaacatagaaaaccaaaatcagtattcacccaggggtgaaacactgaatccttgtcatcatgaaaatcttttaaactcatgtgagcatagcagcttaatttactattttaattcttagctaaactcatataaaaatggtaaaagtgttatacttgggaggcaaagctttaaaccatcattctccccaaatcacatctatgtaaggattagaaatccatgcaaataaaacccaatgtcaataaatatgtacgactattatgtatctgtaaaaatccccaatgtccaacttttatcttttatcttcattcctgataatagtccttgtgtacagtggaactaaataagttacacagtagtacctgctggaaaacttttcaagtcccaaaagaagagttttcagttgtgataccttctagtctgcttttaagatttttacttttcaccaaatgtttcagcccataggtttaaatattttgttttcctaccattttagaattaagagtctccaaattctgagggtgaaatactgtcattaaggcttcagtgttcacagttttactgcattccctctgacttgtcaaagattgcacctcaaaattatcagatggctctgtagactcagaactaatagcaagctgaaaaagaaagaatgtagttgtcccagatgcatgcttacgtttctacaagaaaaaaaagttctaatgtttactgttatttataagccacaatctgtatacataacaaatattaaagcaatatctcagagacatacctatcaaaattagatatgtcaacaacctgacttctagaatggcaagctcagaacccctgtgaacacactccccaacaaaagcaacaaaatagtggcaaaacattcaaaataaaccatttcagaacactggaattaaccaaaggcatgcaataaactgaaaagcacctattcgagaaaaactaatgagcctgcctgagtaagaccagaagagtctgtgggtcttttaactctatccacctgcccaagctcagaaatgaaagccagcagtatggcaaccagtggatcttttggagtttcattaaaagccctatccctagggcatagacaatatttgaccaaacttgcaactccctggaaaatctctattcccagggtgttgttatcatttgattttattcacagctcagcttggtgaaaaaactctgttcccagggtattatagaaaacaatagcaattggttggtaacaacccagctgtccaaggctatgatttcagctagagcaaacaagagcctggctaaagatttaaaaggaagacctgaaaaaccagatgatgatgtggaactttgaagggctgcaacatattcttggggatctagaagaatgaatacatgtacagggctgtgaacatgcctaggaaagaaatgggacagaagaaagccccagtcactcaactctggctatctttgaaagcagggaataaaagctaaagctgatgtgaaaattgcctgaagtttgacatataccttcacacagatatccttgagaaaaaggtagaatatttggtagcataaggcatttaaggaaatctaacccatcactgaataaccactaaattatactgattcagggggtgatccaaggaagtcaggcttaaaaatagaaacaagaacttaaaaaagcaaccaatagaaagtgtcttgagggggcccacttgttggattttgtaaataaagactataaagtagctattataaatatattcaaagaattaaaactatgtttaaaaaaataaaggacccattaaaaagtgggcaaaagatctaaatagatacctcaccaaggaagatataaatggcaaataatcatatgaaagaggttcaacatcagatgtcactgggtaattgcaaattaaaacaacattacacacctattaaaacccaaaacattgaaaataccaattgcttatgaggatgtgttgatacaggcatgcaatgttaaataagcacaaatatataaattatacccctatgtttcttgcagcactactcaaaatagccaagatatgaaatcaacctaaatgtccaccaacagatggatggatacagagaatgtgataaatttttacaatggaatactattcagcccaaaaaagaatgaaacattttcatttgcagcgacatggatgaacatggagaacattatgttaagtgaaataagtcaggcacagaaagataaataccatatgttctcactcatatgaaggaggtaaaaagttgagctcataaaagtatagagtggaatgatggttattagaggacagaaagtatggggtgggagggttgtaccattttacattcccaacagcaatacatgagagtttcaattcttcacattctcctcaacagtattatatttctttttaattatagccaccctagtgggtatgaaatggtatctcattatgcttttgatttgcatttctctattgactaatgatatgaaaaatcttttaatgtgcttattggccatttctttattttctttggagaaaagtctattcaaatcctttaaccatttttaaaattgggttgtttgccttttattatttagttgtaagagttcttcatacattctagacagcagtcccttaccagacatataattggcaaatatttcctccattctgtgggttgtcttttcactttcttgatgatatcatttgtagcacaaaagtttttaattttgatgtaatccaatttacctattttttctttaaggtcacatgcttttgttgtcatatctataaacaattgcctaattcaagatcatgaagattaactcctatgtgttctctgagagtttcatagtttcagctcttacattttggtctttgatccattttaatttaatttttgtgtatgttttaagaaaagagtacaacatctttttgggggtggggagtatgttgctgtccattgtttcagcaccatttgttgaaaatagttctttcccccattgagttagcttggccttcttgttgaaaattaactgaccataaatgtaagaatgtatttctagagtctcaactatattacattgatctacatgtctccccttatgccagtatcacaatgtcttgtttactatagctgtataataagttttgaaattggaaagcatgagtcttccaactttgtttttccttgtcaatactgttttagttactctgagtcttttgtatttccacataaaactttatgaacaccaaagttttactcttaaaacatatcagttacccagcttctatggattataactacaccagctattgcaagttattactaggagtgctaaaaaaaaaaaagaagaaaagactcacttaagttcatcccttaaactttagtaaaccttagtagcttaagtaagataaagaatgcccatgactgaggcagaggaaaagtagcagcttagggtggaccaatccagtggtactttagtttgaaatccaagaagccagtacaagccctagcagggctggacattaagattggctctgagtccccacccaaatctcatcttgaattgtaataatccccatgtgtcaagcatgggaccagatggagataactgaatcatggggacggtttacctcatgctgttctcatgatagtgagtgagttctcaagagatctgatggttttataaggggcttcccccttcactcagtactcattctctctccttccaccctgtgaagaggtgccttctgccatgatagtaagtttcctgaggccttcccagccatgtggaattgtgagtcaattaaacctctttgctttattacccagtcttgggtatttcttcataccagtgtaagaaaggactaatatagtaaattggtaccaggtagtggggcgctgctgtaaagatacccagaaatgtggaagcaactttggaactgggtaacaggcagaggttggaacagtttggaggtctcagaagaagacagaaagatgtgggaaagtctggaacttcctatagacttgttgaatggctttgaccaaaatgctgatagtaatatggacaatggacttctatagacttgttgaatggctttgaccaaaatgctgatagtaatatggataatgaagtccaggttgaggtggtctcagatggagatgaggaacttcttgggaaatggagctttagtgaaaagactggtggcattttgctcctgccctagagatctgtggaactttgaacttgagagagatgatttaggatatctgatggaagaaatttctaaacagcaaagtgttcaagaggaagcagagcaaaaagtttggaaaatctgtagactgatgatgtgacggaaaagaaaaactcattttctggggagaaattcaagccagccacagagatttgtgtaagcaacaggagccgaatgttaatcaccaaatttggatgtctccagggcatgtcagagatcttcacgtcagcccctcccatcacaggcctggaagcctaggagggaaaaatggtttcgtgaacctggcccagggcccccctgctctatgcagcctcaggacatggtcccctgcatcccagctgcttcagctccagctgtggctaaaagaggccaaggttcagttcgggccattgcttcagagggtgcaagccccaagccttagtggcttacacatggtgttgggctacagatgcacagaagtcacaggtgcacagaagtcaagaactgaggtttggaaacctctgcctagatttcagaggatgtatggaaatgcctggatgtccaggcagaagtttgctgcaggggtggagtcctcatgggggaacctctgctagagcagtatggaaggaaaatgtggggtcggagcccccacatagagtccccattggagcattgcctagtggagctatgagaagagggccaccatccttcagaccccagaatggtagatccactgacagcttgcaccttgcacttggaaaagctgcaggcattcaatgctagcctgtgaaagcagccaggaggggggctgtaccctgcaaagctacaggggtggaactgcccaaggctgtggcagcccacctctcacatcagtgtgacctagatatgagacatggagtcaaaggagaccatttcagggctttatgatttggctgccccgctggatttcagacttgtatggggcctgtagcccctttgttttggccaatttctcccatttggaatagtgtatttatccaatgcctgtacccccattgtctctaggaagtaactaacttgcttttgattttacaggcttataggtggatgggacttgctttatctcagatgagcctttggacccagactttgggttaatatgggaatgaattaagactttagggggctgttggtagggcatgagtgtgttttgaaatatgaggacatgacatgagatttgggaggggccaggggtggaatgatatggtttggctctgtgtcaccacccaaatctcaccttgaattgtaataatccccacgtgtcaagggcaggactaggtggagataattgaatcatgggcagtttctcccatgctgttctcatgatagtgagtgagttctcatgagatctgatggttttataaggggcttcccccttcgctcagcactcattttctctcctgccaccctgtgaagaggtgccttccaccatgattgtaagtttcctgaggcctccccagccacgcagaactgtgagtcaattaaacctcttttctttataaattacccagtcttgggtatttcatcatagcagcgtgagaacagatgagtatagataggattcaaggaaagttaaggagtattcaaatcaatgtgtaaatgaaagggtaaggtagaagaagccaataaaggaaaaattaatgattagagagtataggtctcaaattgcaacaattcccttctttttttttttaaatgcttattttgacaaatcacatacttgacaacttaatattaagtttagctgtttgaacgaggagttacatttttgcaaatacaggttggaaaattcatggttgtagtctggatctcaagcacagcacattcctttaatttaaatgactgaatcatcagtttatctattgttctaaactacaggaaaagtatcccagagggaaaaaaataacctcttaagcaatgaaaccctaaacataaatttataagagtgatgacaagtatgtcagttctatccattattgcctcttaagtattcataaagtcacgttaaaaccttcaccttcatcaacaggcagtaggtggttagaaaatttaaaaaaatgacaaaagaaataaaataaaaaacatttaccttcaaagatggtagtttaatgtttgaaattttgaagagtgtaataaagtagattattcaaggaactaaacttaaagtttttgaacatttttgctctggctcttttgaatggaaacttttacccatggtgttttatatatatacttggataaatatctatatttctctccatttatttgggtgttcacacttacgacaaataaacttggcactcatcagacttttagtgcctgagcaaaatccaatcacatctagaaagcaacatagattgttaactctatagcaggtattcttaatctgtttcatttttattatctgacattgattttacaattatcatatggctctaaaagtgaaggaaagacaaagcaaagattaacatttctttatgtgtaaatttctacaaaatactatatttaaattagaatacttcataaactcggtataataaatggtggtttgggggccagagttgacctgtaaaaccaataattaaaacaaaaaaatataaacaaatgcttttctcaaatatcagaagcttatcttaaataggatcctgttcatagtccacaatttaaagggtgtgaatttcatttttaatagtttctggtttcccaacttagaaataaatctacccccacagctaaaaatcattttccaaatttatattatggtcataggaagcaccttattcttatcaaggcaagaaaaaatcagttatgttggttaaactacaattttgatctacattatcatgtaggaaacccattacttctatttaaaaacttagtaagatagtcctggttatgaaactatcttattaagataataactatattacatacagttagtaactatcttactaactatatgaaacaagttatgtttacatattctgtgataatatgtagaagatacttatttgcccatctaaaaactttaaggcataaactcaattactacctttcttgacattccatagtttctacaattcattcataatgtagtttaaaagcatcaggcaagggatcttcagtagtgctttccattcttaggccactttgcttaaaactaacctaagagggcccatttttctttcattgagtagttttgaaaaattaccttatctagtaatagttcttgattatatgtgtcaatgaaagtaaaagattcatgtatttttccaagcagtttattagaattttactaaatctctttatatgcccagattttagtataacttattaaaatgtggaacatttaaatatatacccatataaaaacttggatagaactggtactcatgcataatttcaattacttctggtaggacttgttctttgtataatgtctttgacattctcacaggaaagatttcctaaagtacttcctgtattcatatttagacttgttgatttagactcttggagatttaaaataaaaagtcttgctgtttgtacaaaagtcaccaggtttattaaaattatagaatgcaatttttctcttcgttttagtaaaagtgtagttataaaagaatatagctataatttctgttacttagaaatcaaatggaactagctcttgtttaaaaagctttctctttactaagtttttacgtgtactattattaaaactagatatatacagatactaaaatgggtcaatattcttcatcattgataagataaaaatcttaagtgaaaacagaatattatggcaatttaaaaatacatatttccaagcagatagtatactagctggtattttgtacatatatttattaaaacctctaaaaacgagtgagaaactagaaaactgtagaattctgatgcatatttggaaagatggtaaactcattttgaaacaaaatcctttcttgacaactgagcatattcagctactaaaagcacatgaaagttttaaggggaacagttacagctcttcaggttttggaaaagcaaattaaaggaaaaagaaagatatgttgagctttgaagctaacacgtggactgaatgtgaaatagaacagaacaaggaaaacatgatataagtaagaatttgggagcattgggagagaaaactactaaggctggtcagattttacttgtattcccacatcaaactaaggaatatcctgggtacatactaaaagagaatgagagataataaagttggggcaaggaaaacccttgatggccaatgtagaaattctgcgtctggaattgagatggaaaaaaaaatttaattacatgttttcattgtgctttttaattatcaaagggaaaattagttttatcaatactgcattataattgacttagcatattattttcaatctctactctggagatagcagtaaaaggctctatactccaattcaaataaaataatatagccaataaagacacatttagtttttctttgaattttaattaaaatacaaatagctataatttgataagttgtatcaatctattaaaacttggggttcctggacattgtaaaagaaaattcatttgaatttgacctgtctgcatttccatgagagacatattaaacatcaaaatcctccttgtcctctctaatattttatttatttatttatttatttatttatttattattattatactttaagttttagggtacatgtgcacaatgtgcaggttagttacatatgtatacatgtgccatgctggtgcgctgcacccactaacacgtcctctagcattaggtatatctcccaatgctatccctcccccctccccccaccccaccacagtcgccagagtgtgatgttccccttcctgtgtccatgtgttctcatagttcaattcccacctatgagtgagaatatgcggtgtttggttttttgtccttgcgatagtttactgagaatgatggtttccaatttcatccatgtccctacaaaggacatgaactcatcattttttaaggctgcatagtattccatggtgtatatgtgccatattttcttagtccagtctatcattgttggacatttggcttggttccaagtcttggctattgtgaataatgccgcagtaaacatatgtgtgcatgtgtctttatagcagcatgatttatagtcctttgggtatatacccagtaatgggatggctgggtcaaatggtatgactagttctagatccctgaggaatcgccacactgacttccacaatggttgaactagtttacagtcccaccaacagtgtaaaagtgttcctatttctccacatcccctccagcacctgctgtttcctgactttttaatgatcgccattctaactggtgtgagatggtatctcattgtggttttgatttgcatttctctgatggccagtgatggtgagcattttttcatgtgttctttggctgcataaatgtcttcttttgagaagtgtctgttcatatccctcgcccactttttgatggggttgtttgtttttttcttataaatttgtttgagttcattgtagattctggatattagccctttgtcagataagtaggttgagaaaaatttctcccattttgtaggttgcctgttcactctgatggttgtttcttttgctgtgcagaagctctttagtttaattagatcccatttgtcaattttggcttttgttgccattgcttttggtgttttagacatgaagtccttgcccatgcctatgtactgaatggtaacgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaattttcttctatttgtttgtatcctcttttatttccttgagtagtggtttgtagttctccttgaagaggtccttcacatcccttgtaagttggattcctaggtattctattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagactatggggttttctagatatacaatcatgtcgtctgcaaacagggacaatttgacttcctcttttcctaattgaatactctttatttccttctcctgcctaattgccctggccagaacttccaacactatgttgaataggagtggtgagagagggcatccctgtcttgtgccagttttcaaaagggaatgcttccagtttttgcccattcagtatgatattggctgtgggtttgtcatagatagctcttatgattttgagatatgtcccatcaatacctaatttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggcttgccagtattttattgaggatttttgcatcaatgttcatcaaggatattggtccaaaattctcttttttagttgtgtctctgcccggctttggtatcaggatgatgctggcctcataaaatgggttagggaggattccctctttttctattgattggaatagtttcagaaggaatggtaccagttcctccttgtacctctggtagaattcggctgtgaatccatctggtcctgggctctttttcgttgttaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtcgtgatatcccctttatcattttttattgcgtgtatttgattcttctctctttttttctttattagtcttgctagtggtctatcaattttgttgatcctttcaaaaaaccagcttgtggattcgttaattttttgaagggttttttgtgtctctatttccttcagttctgctctgattttagttatttcttgccttctgctagcttttgaaagtgtttgctcttgcttttctagttcttttaattgtgatgttagggtgtcaattttggatctttcctgatttctctgtcctctctaatattttactagtaaacagatataccactattttgcttttggccagattatgtaaataaggctgacctataagatattaaataaaagatatccagacaggtttaaaattgctatgtctttgcaacagtaagaggagtcctttttcgaggcctcactgaattctcaaatatattttgacttcttaaaaaccaaactatgtgaaagtacaaggtatatttatatggtaaacagcaaatagagtaaaagaaagatcaaattatagtaattttataatgtatgggttcctaaaaatgaataaagtccttaattctcacttctgcttaaggatgtgagttagacaatataatttcttagattctatctttaaaaaaaacccctgggcataaataggaaaggtactatgaattcctcttgaagaatgggctacactaaacacacacctttttttccaaatgatttgattgctgtataattaattacctctgtgctaatatcatgatattgagttgaagctgctccgcatctgagcctgagttttgctaccagttgttcaaagtctttaacttcatggaagcgaaaagctgtttttcctttgatgctaatgatgacagatttgctggaatcatttgtcttatctatagctaagacctagggggtgaaaaacatagaggtcaattaaattttcctttattgttgacaccttcaagtaaaatgtgtttggcttactcttttgtggccaaaagttttggtctatagtatgacttattaagaaatagactttgggtactagttgcaccaatcatacaattaacctcagtgcaagttatttcacttctcaagaaaaaggtctaacatgtatcctttaaaaatgacagtacaaatgtaaaaattcagtatcaaataccaacaatttatttctgacttacgtaaaagatgtcaatgttatttttttctgacagagtacatcaaaagtgatagtctaactttaccatttagtaaagtcttacagctcttactgaaagtgaaaattttaaaactttaaaatttaaaaacaagataagcatttaggttaatgcaaaatggagcttgatcattcaaaaatgtatgacattctcagcaaactatcgcaaggacaaaaaaaccaaacaccgcatgttctcactcacaggtgggaactgaacaatgagaacacatggacacaggaaggggaacatcacacaccagggcctgttgtggggtggggggaggggggagggatagcattaggagatatacctaatgttgtgacgagttaatgggtgcagcacaccaacatggcacatgtatacatatgtaactaacctgcacattgtgcacatgtaccctaaaacttaaagtataataataaaaaaagactttactaaatggaactgagaatatctcagaaggctgtactcttattctgaagaataattattttaaattactaaaaggatattgcatcttgaggttttaataatttatagaattaaaggacattttactctgtgaaggataacattttcaaactaaaaactgatatgtaaccaaatttacattacctctcgtagtggaatgattacactacactgattgccatcttggctagcaaagcagatataattttctgagatgcacattttcccatgagtattgaagtggctgaatggtacccataagaaacattcatgtacttctttcaaactctctcctttgggcagcctaaaaaaggcattaaattgctcactgtgggctctattttccagacctctgtaggaaagaaaaaatgggataaggcacaaatgaatttttagaaatgaattctaaggtatacatatgcctatattgactaatctacatacactgtgcacacagattaaacactaaaaatgctatatttttcaacaaattctgaaatagaaaaaaatacactgattccttgcaaactccttttgtttgttcttttcttccaatttcattttattagtagattaaaatgcacaaaagttagagatcatgtaggtcttcaaactatctctaaggggtgatttcctagaagactattatattatcatataggcataatatgtgactatggttaaaatcaatcctggaagacaacaatgttcctatctggttaccagaaaatcaagcgagttacccagttcaagtaaaataaaataatgaaaatttgtggcataaaaatttagagggaaagagtagtctattaaagacgatattaaaaattaagtgaagtaaaattttaaatgaatgttttaaaaaatctaaagtagaagtatgataaaataatactgcttgtactatgttgggcacaggataggtgtcaataaatacagagggcttattaactgatagacaaatgtagcctttgtgtaaaaagcaattgctttaaatagtataattttttctaggcacacgaaacaattgcattaagcagcaatgccatctgggataataagtaaataatgcaagttctaactcaaatccaacaaagctaaaactaaattcattcttcctgcatatactatttaaatatgtggtagttcatcatgtctttcaaaatacttcggataaacatgaacagaaaaacacaaccatgttaatttttacctcagttaaatggtatttttttcaaactgggaaagctaataaaacaaataaattgcaattttgtgggttcactattatttaaataaaataaagtccatttatgtgaatagaaagttgtccatgatacaagagaaaaaaagcagattgtagaacaatgtgtgatgtccagacctatttttgcaaatatttataaattcatgcattaaaaagcctagaaggatatacgctaaacttaactatcattactgtgcttctgtattgtttaaactataaaagtaatacatatttgtaaaaacaataagcagagcaataaagatattccattttataaaaaagccatttggagactaagtcccaataaattactgttctttttaacttactagaaaaaaagatgtagatatgtacgattttcaatgggctctcctaaaaatgcacacagacaaaaatggatttattatatcttaattaaataccgatttggtgatgaataactcattgatagccttttagactgtattttaagggaaataaaatggcaaaacagtttgtttatggttgccaataaagaaatgaaatacaaaaacaaacgcccacctataatataatacaaacaggattcttaatccttatagaattctatttataaatcatgcatactgagacctagttttggtactgaagtataaaaaatttaccttgctgatctaatttccataaaagcagggaggctcacaaacaaatcctcatgtatatcaattttaggaatagtttaggaacaggtaagaggaacaactgtacccaatgagggctatgtagtgatcatacaaccttctaggtcacttgttctggtctatccataggactttggcttaggttcctcttatactttcccatatagtctatactgacatcctccttgccagaagctgctttcactagctatttctggatcatctcctctccttttcccctttggcatgctcattttagtcaactgttcagaatgttcagcaggataaaagatatctggtcagtttcaacaaaccaaatataatggcaaacagctatcagacacatacttctgaaggaggcactaataatgattaatatttgcctcatattttatattttacaaagtgctttcacacatatcatgcccattcctcataagtgccctctgaggtagaaatgacagatgaggaaactgaggtcctgagagatatgacttgtctaagggttgttctactttcattctaaagtccatgctccactgactccacgaacttgcctcttcattaaaaaatgttttctgtaagttattttaaaaaataaacaatatgtttaacaatttcagacccaaactgtctagactattcatagagaaatttagagttagactaaccacacataaaaatctctgcatttctaaaagcattccagggcaagtcctatctgaatctcaagaaataattttcaaatctaacttctattatttcttacaattaaatttcctggagagaagggtactatttatgtaatgcatatgaataaactcacaaaacacacacacacccacaatcaactccaaaaaaaaccctatcatataatatagaagagttaacttttaatggtaagcaatactatcttcattcttatggtcaaacaatactttgaaaactaaaaattaagctttgaataccttttggtgatctgtagaggattataaaggactgggtcattatcaaatgtttccttatcaaaaagtcttctaatggcatagtttgccagctgttccataagaaggtatgtttggttaatgtgcaaaaacattgaaaagtagtgattctctccttgggaacacacgtgaatactctctgtcagtatgacatttgaagtcttttcaagttttgagacttcatcccaggagataatgagttttactgcaaataagaggtataagcaggtatgattaaattttcatagtgatttatgtttattaatcagttcttctgaaacaatagttaatcccttgaaaaatactataaacagctaaaatagtttagagttcaagattagttaaaaatttgaagcatcaacatgaacgtgcaagaattggtgattccaggaagagatctaattttaaataatttcttttgagatagagtctcactctgttgctcagactggagtgaggtgacatgatcatggctcattacagccttgacctcccgggttcaagtgattctcacatcccaagtagtccccccaagtagctgggactacaggcatgtgccaccatgcccagctaatgtaatttttttttttttttttgtagagacagagtctcactatattgctcaggttcgtcttgaactcctgggctcaagtgatcctcctgccttggcctcccaaagtgctaggattataggcgtgagccactgtgcccaatttaattttagataatttttaaaaaaaatgattctgatttgatatttaaatctatctctttatataattacataattatataactaccaatgtaaaagctgtttgtatgctataaatagcactgtttgattcttctttgtagctacaaagtgagatgtgggccattaggtactatggccactatattcaaattgtatgtttaaaatagattaaaacacagactaaagcatgtaggtagttcataacaaggaattgaaagcagtcatatgccagatcatcatttaatactgactcacttcccacgatatgcaaggcattctatatacacttctaatggttttatgttaagcaaccagtcttaaaagagttctttccctagatgaaataaactttttattgtacagtttaattacctttaatatcaatcctattattttatttacaacctaacatcattagagttggtaggtcagacagcaaattcaaggccatagtaagcaatagaaaccacttactttctgatcccaacaaaaaagaatagaagctcagaaagttggtgctaagataaagccaaccctgacaaggaacccgtcctttccaataactgcatgaataataggtcactaacttctccttctctggtaaaccaaaacatttttcaaatttcaaaagggcttctcgaaatttctcaggatcatcttcttttgcaaaacaatgttttccctcttcagcaattaatccctaaaggagacaaaatattttctgaaaattcatcacctaccaacaaaaatatatttcatacattcaaacagttgattgaatacaattgtacagtcagccctccatatccatgggttcctcatccatggattcaaccaaccagggattgaaaatatttgggaaaaaaattctacaaagttccaaaaagcaaaacttgaatttgccatgcaccgaagactatgcagagtccactcaaatgaagtgatgcataggcattgtattaggaatgaatagtctagagatgactttaggtatataggcagatgtgcataggttatatgcaaatactatgccattttatattaggagacttgagcatctgtgaattttggtatctacagcggcggccagaaccaatccccatagatacctagggacgactgtatatatctatacaggtacatatatcatatgtgtgtacatagataattctcttaggacagaggtaagcaaattttcttcagttttgtgcttaggtttttttctgaatgcctcataaggaactactacaaatacaagtgctaaatatatttttttgaatgaacaaatggtttattcaactcaaaactcaagagatattgaaacaaaaatgcccctaaaagcattcacaagggcaccaaagacaaacatttaatgaaaggggaaaaaagtaaatccagctcatgagaaaatatataaaattctgaaaacaatatgtcagtaattggtacctaaagaataaccagtatgttttaagagaatatttcaatatctatcaatctccccctgtgctaaagactttacagttttctttagcacactgattctgaaattcatatgttcgtttctaccaatcctgaaaggtgccagtgaaacaatgaccttccatgcaaactttgatcctcatacatgagagtcaaaggttttggcactccatctacaagatatatccgtgccacttactcttatttttccttgtacaaaattagtaatatcttcatttgaatcaaatacagataaggtcttcataatattttgttccaaccaatcccaatgcttggttatttcttctctgttggctcctgattaataacacaagaaaataaaacacttaaggaaaactccacaataaaactgctcttgttatttaaaagcatagtttaaaaagaaataacattttcactttaaaaaatgatggtcataaaggagtaaaatatttacatttattcctactttatccctctatgtgggcatgaacagtacttctcataaatagaaagaacaaaacatttaatgaaaggggagtaaagtaaatccagctcatgagaaaatatataaaattctgaaaacaagatgctagtaactggtgcctaaagaataaccagtatcttttaagaaaatatgtagagtaccagaaaatacataatgtgtaattcaatccttggtctccaaataatgcagttagtgctgtgtctataatatgtgtggctgaaaacagcatgtatgtgacaatcctatgcatgctaagtaaatgtagattttaactgtggccactctacttatttcagaagccacaaaacctttgctcagagcaaccccattcatcaaaagacctagtaaacttacagaaatttcatacaggaggttagaaattctgtagcaaggttaaatccatgtgacccgctgaatcagtgttaagaggtttgctgagggtgagattaaacattattagccctagttgctttgacttgaagaatatttcagtatctatcaatctcttcctatcactcacataccattaaagtcttctcagcactatggattatataaatattcaaaagaaatatgctgactttttagtatattttataatatatggagactggcatattaaaaaatttgttgacattgcaaatggcctatttcctacaattcaatcagaattttattcatgctactaagtcaccatagcaagagtaataactgtctttaatggaccacaaataaaagccatgggggaaatgttaaggccttaagtttgattcttttggtataaggaagcttcattagtaggtaactacactatttctgcatcaggttaatttgggggaaataagttatacaatcatctttatttaagtagaaaggcctttttttaaaaaaaataatttttactaaccagatttagagttgagattacagaattctcgtgatgtcagcaggtataatgtcaacctcatttaggttaagtgacattcactttaagagggccaggaggaaagactcactggcaacactaaaagaaatttaggcggaaatataaaaaacaagccacacaacctaaaaaattaattgtatgctatatgttcacacatatgaatgttccagaaactcatgtgcttttgttctttttaaaaaattataatatatctactttagaagagagggggataagaagaaaggcagtttttcaatatcaaaaaggctagaaatctgggattctaatttagaccaacattataatggcatcataaaaggaagtaagaaactgtcaatgcagctttttaaaaatttattttgacttgctttattagaaaggattatcctaattccttttctacccataatatatatgttgaagcatctgaaccaccctggcatgaatgaatatgtaacattaactgtaagacattccttcatatttcaaggatatgatgctttttctgagaaggtgggaatgaataaaaaaggtttaattttccaggcttatacttccttaggagtcattatgttttgggttcacagataacttcagattcttctcatttgagttattagtaatgaaacaatttatttcatggagaagttctcatcttcccagcagttggataaagcagaagttgaagaaaggagttatatagcagtaacactgaccaaaatctgtgcagaatcagccctgctagaccacatgcttcaggtccctcacaccaatggattaaaaaaaaaaaaaaaacttaataacccatatcctttaaaaatagaggtcttgctattctctcaaagtaaagttgcacatttaatttgtttttaaatctcaaagcaactacagactataaataaatatgaatactcagctttgtagtacccttatttaatttgaattatgttttaaaaatcatactcaccacatgcaattgacaagtaaacttgagaatctggtgtctggtgtaggatgcgaaatggagctactttagcagtagagtccaagactgaatcaagagtcccaaccagaagccctgttgtaatagaaagattgttgaaataaggactttacaagagataaatcaaatctgtatcacttcatataacaaactaataaatttattttaaaacttttctagcccatagagtccttacagagatttttcttaaagaaaaaatacatttgggataaagagagattacagtatgccaatgtgagtagtatctgagaaaattatctttcaataaaagagttaagtcagcttcaattgtccaaatctcaaaatgtatctgcagcacttatgtatctcgttcataaggttgtatgtatattagataagaatgtagaatatagtactatagactaactgggtttaaattctggctctgtcgcttgtgtcaacttgagcaagttaaagtacttaccctttctgcatcctcatttgtaaaataaggttaaaacagatcctactacaaagggctgttgtaaagattaaatgagttgttacatttaacgcacttagagcaatgcttagcacacagtaaaacacccgatattagttaatactattattatttaagaaaatcttagatatttaaacaagataaaaccttgattaaataaaatgcttctgtacagggattttcttttcaacaattcttaattcctcaattaggaattcaaggttcttgatcaattagttccagtttaataatctaattatatttcctactatttcctagaacaaagttcactgttttcttaaacaaccagttaatttctcccatagggtctttgctaagcaattatcattttacctagaaatgctaatgaaaaaaaaagaaatcctaatgaaagtcttctagtccagtccaactaatctgaattctacattttcttcaagacccacttcccctatgaaatcctcactggctatcccaagcaataatactttccattttctctgaatattcataggacttagagtctatacaggttgagtatcccttatatgaaatgcttgtgaccagaagtgtttcagatttcagattttttcaggttttggattaagtgcatacacatactgagatatcttggggatgggacccaggtctgaacatgaaacttatttgtttcatatataccttatacatatagcccgaagataattttatacaatattttaaataattttatgcatgagttttgactgcaacctgtcacatgaggtcaggtgtggaaattttccatttgcggcatcatgtcagcaatcaatgtttcggattttggaacatttcagatttttcatttttagattagtgatgtttaacctgtactacacaacctagcatatattaggctggttattataactactttctaagagcttcatgtatataatttttgtctctttatctagattatttgtcctctgaggacaataaccatgtcttctgtctctgtgtttatatccataactttcaacatattgctgcacaataaggatatagtttgttgatttaaccatatcaatgggatggctgaaatatataaatttaccttccttttctggaagctctgattggttgagtgttggttttgctttatgaggcatttccctttaatttagaatacagatttttaagaaaaatttaattcaattataaaccaggcttttggctctcttcctattttgacccacttaaaaagaattgagattttaagcaaggtttgaatgagaatatagatagattggcagatgctcacatttgcctcacatcacttcctatcacattaggaagttacatgcatagaaggaggtaaactagaagagtaggagataagacaaagacataaagagaaatttggcttagctgaaaggaaaggataggagagtagatacaggaattgataaaaagtaaaaacaggagtcacaaatgcagcatagcatcaattagaaattttctgaggattttgatagggcaaagttcaagaaagaagattttggcaatggcagtatgtgcagattatagagataagaagttatctgatatgaaaaaaagttcaagtatgaattgaagcttttaaaaaatagaaatgagaaaactgacaaatattatgaaagagaaagtattggggaaaagacaatgggaatgaggatgagggaaacagaaaataattatatttcaactaatgaggagggaattactgatgggtttggggataaaaggaaaaataattctatcacttttagcattgaaatagtgactatgagaaattggagatttggtaaagtaaaaagaaagaaaagtaggagccaaaatatgcagatagtgtcttcagaactatgtgattaaaattactgagcattttattctctttgaagcaattgtgaatgggagttcactcatgatttggctctctgtttgttattggtgtataagaatgcttgtgatttttgtacattgattttgtatcctgagactctgctaaagttgcttatcagcttaaggagattttgggcttagacaatggggttttctagatatacaatcatgtcgtctgcaaacagggacaatttgacttcctcttttcctaattgaataccctttatttccttctcctgcctaattgccctggccagaacttccaacactatgttgaacaggactggtgagagagggcatccctgtcttgtgccagttttcaaagggaatgcttccagtttttgcccattcagtatgatattggctgtgggtttgtcatagatagctcttattattttaagatacgacccatcaatacctaatttattgagaggttttagcatgaagcgttgttgaattttgtcaaaggccttttctgcatctattgagataatcatgtggtttttgtctttggttctaacagttaggaatccaacttacaggggatgtgaaggacctcttcaaggagaactacaaaccactgctcaatgaaataaaagaggatacaaacaaatggaagatcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaaggcaaaagaaaaaagctggaggcatcacactacctgacttcaaactatactacacggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatctaataaatggtgctgggaaaactggctagccatatgtaaaaagctgaaactggatcccttccttacaccttatacaaaaattaattcaaggtggattaaagacttaaacattagacctaaaaccataaaaaccctagaagaaaaccttggcattaccattcaggacataggaatgggcaagcacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcacaacctactcatctgacaaagggctaatatccagaatttacaatgaactcaaacaaatttagaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccactatgagatgccatctcacaccagttagaatggcgatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggactataaatcatgctgctataaagacacatgcacacgtatgtttattgcggcactattcacaatagcaaagacttggaaccaagccaaatgtccatcaatgatagactggattaagaaaatgtggcacatatacaccatggaatactatacagccataaaaaatgatgagttcatgtcctttgtagggacatggataaaattggaaatcatcattctcagtaaactattgcaaggacaaaaaaccaaacaccgcatgttcagactcatagatgggaattgaacaatgagaacacatgaacatacgaaggggaacatcacactctggggcctgttgtggggtggcgggaggggggagggatagcattaagagatatacctaatgctaaatgacgcgttaatgggtgcagcagaccagcatggcacatgtatacatatgtaactaacctgcacattgtgcacatgtaccctaaaacttaaagtg

SEQ ID NO: 4854 - DNA, 10457 bp, human
gatggattttgcaaagctgtggttaacgattagaaatcctttatcacctcagcccgtggccccttgtacttcgctcccctccctcaggatccctttctccctctccaggggcatctccccctccaaggctctgcaaagaactgccctgtaagtatctccatcctgatatagttgctgccttttaaattcaccgaggtgggcactcttccttcctagtcactatccattcaccccatggtggagccaggctgggccaccttgggtttctgagtgaagggtatgggaggggaaactccggtggcatttgggttggtggtatttgttccctcaaagctatcacaaaggttcaaatctttaaaacttcaggaccagagaaagcactctccaaatcagatattttctggtttgggggcttaaaaggactgggataaaaattggaggaagggagccacagtttacccctctgcctaagtgtaggggactgaggagtggcagaaggggcactccctcacagccagctccagtgccctccttggcatgaaggctcagggaggtagcagaaggtgggttcctaagtgaagtcataaagtttccccatgaggtccttcaaggactctccctcactggtctgcaagtctgtcattagaaattccttctttcgactgaggtattactctcttcaagtgccctctttgaaaatgcagttggaaccaaaacattcacagcacttatggccggggagatcgtaggcgatttttgttttctaaattctgcctttctgtgttttccagtgttctaaagtgagaatgctttactttgatgatcaggacaaaaatcaacttctttttcaaacaataagaaaatctctcaatccagttgcaattctctgaactgccatcaatcaattgatgtagaaggaaagatgaactgctctaaggacaaactttcaagaaagtagggcctcaagggaatggctttgccacctactagtgcccttggcagctggaagtgagtttcagagaagggggcaagtgtctcagattcttatgaggggcagtgagatcaagggatatagaaatgaggctgactgacagaagagggctgtggtggccatcatcacccccagaaggccacatcagttccttccttgagcctgggaaccccaagtgccctgtcccatgtagtcttaggagggtactgccaaagaaagagtaccatgcacaagactcttggagcaagagatggggagaatagcagggaaagtacctaggtgagaaggggttaagtcaggagctgcggtcaatcttgaccctcctaatcctctcctgcagctccaatctccccactagggaagattaagtaaggatcctaagttaaactttcttgcccagtccttgggccatggagtatgttggccctatgcccagaagacaaattcagctgacaaggcctagagtcctctgtacctccaacgcagccagtacttgacttctaggaggatccctcaaagagaggcttctattaaaactggctgcttctaataacagctcttcagtcttctatatttgtcaaagtggcttcctgtccccatgcctttatttgagactaaaaatcttggagatgacaaactagggcctagagaagctataggacttcctcagcaggttctaggcagaactgacacaacaagaagctagatcttttgattctaacaccaggaccctgtctgccctcacctctactgctcatcagacaaacaaaaacctggctgaatccagcctgtctcaccacccaaccattcgccatttagctggtcttcctaactctggtggaaagctgaaccccccctccatggggccatttctatcacttgaataagctccaataacttgttcttcctcctgcctgggcatgctgctatgccaagtcagactctagagattccaagcctcagtaatggcattttcttgactctgccctctccctcaccccaaaacacttgcctacttactactacttaggacaggctctggggagaggctttcctcttggggacactgttgattcccttgggaaactcaagcttgactcttcagctgccatcccaggaaggctgaagcaggagctgctcctctgggaagcagtaggtcttccccttgaaaacctcaaggtatctcaccaattctcactgaaagctcagatacaaataggaggaagaaaggaaaagtattgaacccagcctgggtgaggagcagggagggcccaaggatggtttcaaggcaaggatgcatcctcaaagatgatttgcaattatccaagcaaatggtggatggtagaatagcatgcttacgggcttggagacagagagaaaggcagtcagagaaattcaagtgcttaggtttggctggatcatatgtgtatgtataggagcataaagcatgaggttggaggttaatggtgtgagatgaggctgtgaagaaaagccggggtgaaataatggagggctttcttggtttcctgggctagcaagtttgaacttcatcctgaaatacttaagagctctgaagatttttttttttttttttttttgagacaaagttttgctctatcgctcaggctggagtgcagtggcacaatctcggctcactgcaacctccacctcccggttccagcgattctcctgcctcagcctccctagtagctgggattacaggcacatgccaccacgcccaactaatttttgtatttttcgtagagacggggtttcactatgttggccaggctggtctcaaactcctgacctcgtgatctgcccgcctcggcctcccaaagtgctgggattataggcgtaagccaccgcacccggctgagctcctgaagatttttaagcatggcaaagcgtgaggtgaaagtcacaatttgatttcaactttacaaagatctttgactactgggtaggtaattcattattgcaggattggggcagaagtggaattagagagatcaatttgaggtgtctatgagattttcaaatagacaagaaacgatggttgcatagtctgaactatggtttagggcagtggcgacagaaagaagtagatggattcacagtctatttttgaaggcagacctgatggtacattataattaattatatgtcaacaagaggtgaaaaagcaaggatgactggcttgggttattaactcagtgacagccccactgaggtaaggaacactgcatgaggagcagtttgggcatggggagcaaaaagggcagatgattccagctttgcaaatgttgaatttgaggccattaaaacattcaggtagggccattccaagtaatagttaactacacaaatcttgagttcaggagagaaatctgtggcagagatatgaattcaggagtcactggcatggagacagagaggatgagataacccatgaagaatgtgaaggataagaagagccatctagaagtcgagatgaaaccctgaggaggctagaggggcagagatggatagttagacttaaagagtgagcagaagaagaggaacttataagggaaaactagaagaatcattttgagaagtagttaaaatggagtggtgttacagaaaacaagggagaagatagttttatgaaggagagagacaaggtgagatgacagagatatgatcattgaattttggatcaagaaaagagttgataactttggtgagaatattttcagtggagggctaatggtggaagccagactgcagagggctgagcagtgagtgggagggtgaagaagtggagacatcaataatgaatggcttgtttaaggatcttggctgcaaagagaatgatcaagataggagtaatagctgcacagggaggaggtagagtagggagctcaaaaagtagtagtaaatgtttgaagcagtcatcagaagggtgcttaccagggagaagtagaaggatttccaagcagcactgaaggcctcaatgagatacatagtcatgatcaggacaggtacaattgtgccaaggttagcaataagaaaccaatgtcaagaaagacttgctaatgagtgacagaggtgagattcaaactatgtttctctcccttcatcaaatgtttatcggctcctgctctgcactgctttgcatcaacactggcattggtgtttccaatgctgatgaatcgtattgactatcaatcatgtgcccaatgctgtggaagcatgatagacatttaatatatattttttcacccttaaattgtttagaatttggttgaggagacaaaatattccacaaatgcatatatattataaatatatataatatacattatatatatacatagtgaagctctgctgtctctctctccccccttacctctttcttcctctgatcccccatctctctctttcttctttcccaacgttgggcagcacttcaatgacccttacactgaagcgttattgactcatttggaaagtccctatattttagtcatatggagcccctcaaacctctttgccaacttcattcatttattaagaagacagtttttgaattgctgctctggataaagcagtatgtaaggcacatgagatacagagatacataagatatagtcttgccctcaagtagctcacaggctaatagggaagaatgagggtttaaacaggaaattgcaacataatgcaaaatgtactatctctgcctcagtttcttcatctatacaatagggattattagtgcctaccacaaaaaaacctgtgacgactaaataagttagcatgtaaaaagtgcttataatggtcccataagaaacactacataagtgttgctattattattattactatgatggaagtaaacacaagatactgtaagaatagacaggaggggtacttgacccaggctagagtaagagacatctgtgctgaatcctaaaagatgagaaggcactaaacagaggaagaagaatacataacactctgcatagaatattctgttctatttctatttgggagcaaaagaccacatggcatgattgaagaactggaagtaatttaattccacaatagtacagactatgaggagggaaatggcaagagatgaagcttgagaggtcatggggtaaaccaagcaagtttggactttactttttagcaaatggggagccactggaatgctttatgtagagtagtgactcgatcagattaatgtgttgaaagatcaccttggcaatgatgtggagaatgaattgggagaaagacaagttagaaagctgttgctataatccaggtgaaagagaatgatgaggtcgtgcatggtggctcacacctgtaatcccagcattttgggaggctgaggtgggcggatcacttgcagtcaggagttggagatcagcctggccagcatggcaaaaccctgtctctactaaaaatacaaaattagctgggcgtggtggcgtgcacctgtagtcccagctactcaggaagctgaggcacaagaatcacttgaacctgggaggtggagattgcagtgagctaagatcacgccaccccactccaggctgggcaacaaaagcaaaattcggtctcaaaaaaagaatggtgaaactgaactagggaagtagcagtggaaatggagagaaaggaaccatggatttgaggtatattcataaggtagaactggtgggacatagggactataggatgcaggaggtaagtagaagaaaggtgctaaagatcactttccggattttggtctggcacaagtggatggatagaggtatcattcagtgaacacagggaacacagggaagaactgtttggggaaagctgcatgggggatgtgatgagttcacttttggacatgtcaaattcgagatgtctatgagatttccctgtggagattctgactaggtgattgctctgccagtcttgaagctcagaagggtctatcctggaaattcagatttgggagggtcagtggatgggtagtagattaagttatgggggcaagatgagtttgctcagggacagagtgttaattgagaaaaggatggacttctgaggaatactcacatttaagagatgagtagggaaagagaaatcttgaagaaggctaaaatggaatagccagattgtggtgggttgaaaaattagtgggttagttcgggcacggtggctcatgcctgtaatcctagcactttgggaggctgaggcaggtggatcacttgagcttaggagttcaagaccagtgtgggcaacatggcaaaacctggtctctacaaaaaatacacacacacacacacaactagccaggtgtggtgatgcgctcctgtagtcccagctacttgtggggctgaggcaggaggatcacacacacacacacacacacacacacacacacacacacaactagccaggtgtggtgatgcgctcctgtagtcccagctacttgtggggctgaggcaggaggatcacacacacacacacacacacacacacacacacacacacaaactagccaggtgtggtgatgcgctcctgtagtcccagctacttgtggggctgaggcaggaggatcacttgagcccaggaggtcgaggctgcaatgagccgagatcatgccactgcactccagcctgggtgccaaagtgagaacctgtctcaaaaagaaagaaagaaaaattagtggatcagagggtcttgtagagaatggggaggtgtgcccttgacccttagtgtcctgaatcttggcaacaccgagggctccttgaacacggcaaaatcttatatggctctgagattccaaagcattgactcagatacctgcctcatgcaaagccctatattctagagcagtttccctttcctctgtggcagactcttgtcccccctaacagatggcccagggaatttcagggccccctctcagtcctggaacccttgttccagagtgctccctcatcatccaagaggctgatgatgggagcatctattaggagactggacaggaaatgtctgggcatgttatacatgcaggaggccttagactaggctgcagagggggatttgggcatggctgggaggatctgaactctcagagtatggacagaaggctttgctgcccacccccatctaccctggagtagattttcaccatgggcagaatgatccagggctaggccactactctctaggcccctggagattcaagaggcctctaacaaactggagtccaagactacattctaggatctgttcctcctgatgtagtctgcagtttggcctcagtctgcaattgaggggccctatggcactgttgcttggcaatgtattaaacagcaggccttggagactagcacttgagttaacacagccaccacaaccaccactgccatcatcaccttcccggaaagcagccacctgtctggctcctggctttgtccagctgccaacctaaggcatgtgcctacgcaggaggcgatgacattttggctccacgttcaaagttgttttttttttcctttctcatgtgttatttctaaagataacaaaggtcaaaaggcatccagcgttttctggtttctcataagcttctggtcaatatttaatctggtttatggattttttttaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 4855 - DNA, 32838 bp, human; identical to SEQ ID NO: 3556

SEQ ID NO: 4856 - DNA, 80923 bp, human; identical to SEQ ID NO: 3557

SEQ ID NO: 4857 - DNA, 10614 bp, human
tgtagtaggcccttgctaaatttgtcaaaagaatgaataaacgcccccccaaagacaatgaggatgcccctcagcacgactcctgtattcctaattgctgggccttacagagctcagcagggagctagaatccaaggggcacccaggaaaggcttagtttccagtgtttgctaatcatgcttctgataaaattgtgggagagttttcaagaactaaaaagccagccaggcatggtggcctgtaagcccagtactttgggaggctgaggcaggtggatcacctaaggtcaggagttcaagaccagcctggccaacatggtgagaccccatctctactaaaaatacaaaattagctgggtgtggtggcacatgactgtaatcccagctactcaggaggcaaggctggagaatcgcttgaacccagggagcggaggttgcagtgagccgagattgcaccattgcactccagcctaggcgacaagagtgaaactccgtctaaaaataaataaataaatacaagcctggctgattttttgggcatttcttacagaattggataaacaaagtggtgcagagcccaaaactagaaagccagaagacttgggttaaatctctcacatctctattccccaatagtgtagtaactgtggataaatccttttggagtgctaggtctcctttctcccacatctaaaatagtatttattatgcaactccttcctaggggcaggacatgtctgtgaggtgaacaagatcatttctgtaaattatttgggatgcttatattcagatataataataataataaaaagacaccctttaggtctatctcactgtaagaaaaccaaatatataaaaactcaatgtatgttattactaaagaacttttgcaaactcccctaggcctagagtattaataatggggttcaatctacccaaattcaattcatgcccagctgtttcagaacacaccaattacatagggaagcatttagcacattgccttgcaactaataggtaattaatatttgtttattgactccttgatcagtaatgcaaagtgtacctgtactgggacatcttaactctgacgtgacaaaggttaggctttccctagatatggagaactcaccatctctctgttctttttccagtcccccaaatctgctttcatcagtgctgcgaagaaggccaagttgaggtccaatcctgtgaaggttcgattttctgagcaggtggcagttggagaaacagatgcagtaagtgtagctttggctccctctcctcagcccctggccataatctgcctggctgtcaagctctcgctctggggcttcttatagtggacagctttccgaatgggttagagtgggagcgtccaggtgctggagggggaaaagtagtgagtgaagagggatacgtgacatccagagaggccccaggcattgtggggagaaggaatatatattgattcactcaagatccttctgatgcttagagaaatttccatccctaacacagtagcttacactcaaagcaagtgctccataaacatcttttgctacttgatagaaacaggaaggaaataatggcttcctgaagactcagggaatgagtggctggtgaaattgagctctcttcacatttaagtgatcttgcaactccacatcttgaccagaaaaggccatgcagtggtgagtaaagttgcctaaaggaaatgatacagactctcattaagtcaccaagtttttattaggcacctgctatgttcttagcaccagaggggaggcaaaataaatacctgttccctgctaccagatacctctcagcaatgttgagggggacaagaggttcagattgagacaatacaaaatctactacggggtggtattgtttcgaaagacaggtaatatttgacagcccatgccatgcagctgccaatttggggagtcttggccagccacagtgtttctcactgctttgggaggtttacatgcagtgaactgtcggctccagatgtgcaaatgagaagaggcaggtgaagagcagaaaagaagtgtgttaagcagtcatgcattctggccgagtccttcaggaatctgcagaagttagtgataacctggtggggacagaggggatagctagagctaacaggcacttgtgtgcttttgatagctgtgatgggcagagctgtctggaggcccttggcatttacgtactgaggaacagccacagttgttgggagaagatagcaggcccagagcagggaaatcagcagggtgccaggcgcttctatattatttaaggcagaattagtgagaagaaggtatagaggacacaggtgtcttccatctccatttccctgactctcattcccaaactcagtctatgccctcctccatctctgcatgaggaaggctggcaaacccaggggactacaggaccccactgggcaagctgtctgaataattgatggttgggatctgtgtcaatcctagaagaaaagttttaagagaagtgatcattgatgagcagaggggaaaaggagtaatatggagtccctgcaaatcagggtgaaacagaccccgaggtccaagtcaccaggaggatatgtgtgtcctgaatgcttgaaaacccagaggacgtatgacttggatttggtaagtatgaacaggcttatcctatgccatctcaacattgcagagtaatcagtcaagggcaggccacccagtgaagaactccttcccttcctccccactcccctcccctctcttctcttcctctcccttctacttccccttctccactttctccttcttccaccatgattcccctctccatacgtcacagctaggttacaggcacagctagtctacaggcgtaacgatgccccccactccagtctattctgaatgcaaatgccacagagtagctaggacccacctagagtgacctcattctctcggacaggccaccaggcatagtgtgaggctcttgtctgggtgagagacagacatcaatcttccaactctcactgcactcgtgaaattacctggtgttacaacatcaccctcctccatgctgccgccagtatggaccatagcagcctcatcacaggtcgggagccgggggagtccaggcccaagtgactccaggctctcctatcaaccctttcctttcgtgttccaaggctttattaagcagccagagcaaaaataaatcctgtgggtgatccttgccagctctatttttaagcaaattcaattaagtaattatctgagtccaacccagtgtgctaaataaaacctgccaccactgggatccggggccgctgggcctggcaggagcaaggcatctcaagatcagggaggggaccagggagtcacactcttccaattttatatcccaccacttcccaccttgtttccacagccaagcttgtctcttggctcctcaccaccatcaaccataccccaacccaggaggatttgcttgttcctctttccatgctttgtccatgatccatgacagtctctaggtctagactgttctcatctggcttctcaaatcatccacacccactgtctccttcaaaatcaaaatccaatttgccttatctaggaaactttagccatcttatacctgttggtttgctttggttttataatgtgtatgtgtgccaagtcactacaacaagaatttaagactggatttaaatctcctgtagctctcatagagacttagcatagtgttgggcatacagtagaggttcaatgaatgcccagtgaattaaggaatctggttatctctgcagcttttccattcctatagaactgatgatgatgttggcccagggaaatggttgggatgagagtgatcattcagtaagtgcacatcaagcacctactgcccattcattcagcagccatttattgcgcaccaaatgtgtgccaggaactttgtttagtgttgggactacaaagataaataggacatggtctttgtgctctcatttcaccatttgattgtgaaagacaaatatccttcaaaaatatgataaaggtgagtttcggcagcatagtgagaccctgtctctacaaaaagtaaaaaatttagctaggtgtagtggcacatgcctgtagtcgtagctatttgggaggctgaggtagaaggatcacttgagcccaggagtttgaggctgcagtgagctgtgattgcaccactgcactccagcctaggcaatagagcgagaccctgtctcaaaaagaaatcaaaacaaaacaaaatacggtaagagcattgtgagaagcgtgcataaattgctataggaatgcatggaaagaccaggtccaagtatctgatgatattagaccaaggctttacagaatacatatttgagctgggttttgaaggataaataggagtttgccaaagaggaaaagagaaaggcagagggaacagctttttttctttctttcttttagagtcctcagagaaagagaacagtctttatttaatgaatttttattaagaatgtctcaatcagagtcagtacctcccattgctagagagcttttgaaaatgtctgagggccaggcatggtgactctcgcctgtaatcccagctactactagagaggctgaggcaggaggatcacttgaactcaggaggcagaggttgcagcgagccgagatcacaccactgcactcccacctgggcgacagagcgagactctgtctcaaaaaaagaaaaagaaaaaaaaaagaaaatgtctgagggtgtttcaggtcatcccaatgctttggtgtgctactggcacttcatgtctcagggtcggagatgctaagtgttgtgcagggagggggacatccctgaataatgaagaatcatcagaggtatggaggtgtgaaagaggtgtgggtactaggaatagcaagacgtgactctggagactaggcaggggccaggtcagaaagggcctagggaggggaaaaggcagagcaaaggccttgacaggacgtgatcttggcttgtgaagggcctcagggaaagggaggtatcaggagataagatcagtctagaagctttgtagaaggtgtttaaaaaaatgtcagagataagatcaggtgggtgaggtagactccaaaggaggcctctcatcagcccttcagcgggtgtgtggtgatccctttgctctgatctgtggaggtttgaactacagtagaatgtgggtgctccgtgatgtcaaatggaggcgggcttttgatatggctcagtgtcttgttggggagtttggttctggtccccatgtattattgatctgctctttcctctgtctctgccctcctacacctttggctctctgtctccatcaccttttctctctcctttttcacacccttcctctggcttcctacttccttctaaatgagccggtctccttgtcctttccctgcttgttcacagaaaatgatgaagaaggaagctctcctcctcatccctaatgtcctgaaggttttcttagaaaatgggcagatcaagtcattcacatttgatggtcggaccactgttaaggtacatacagtctcctccccctggtcagcattgccctctccagagtacatgcagttgtgtgtcctgtgttcctctgagtctgcacatagctgcttgccactggagtaaggtggcctttaagctctggatgcttgttagcacaaggctgcaaaaatgcacagtcccagatgagagtggtggtagaagtttgcatgcccaactgtgtgctagtaattgttaaaccgtgtgtgtgcacttatacttgtgaactgctctgtgtttgcgttacatggggtccttcaggacttttaagaactaaagaatatgaagatcattaagccatttataaagcaaaagtgatttatattgataccataacacctacacaagtttatgcacagaaataaacacagtctcttgggagattagcttagttatggcttgctttttaaataacaacctgatctcaagcactgaaccaagatttgaaatgtccagccacagcctctttggctgttcttttcacaggaagagcaattactgagctgtgattcttcacagctcagccaggtgtcagaaagtcctagtgactttcctctaatccttaggaatagaagtgatgatatgattcacccccagattcaactctgctctgggacagaaatatccattcctgcatcttctggactctctccagaaagagaatgccatccccagaatgagtattttaatgcaactaatgccgcccaaactgctgggcagctacggtgtctacccagaaaacctaggttggtccacaggtaccctgtggttcccatactgggaccaaggcaatcctataagtaaagaaactcttggaccaacaaacgtttgctaagaggagttatcaggtactcagaatgggtcttgccagtgattttcaaccaggattcctacttcccactcttagagagcttttggaagtgtctaagggtgttttaggtcatcctaatgatttggtgtgctactggcattttgtgttttagggtcggagatgctaagtattctgcagggagtgggacagtccctgaatggagaatttttttgaaaggcttaggcctaggtgggtcccccaggggacctaggaccaaaacatactacttagggtgccatagaatgttcttttggctattgaagggggcatgggagggggcattgaaacagaactagaccacccaggaggtgtccaaatgtgccttctccagatgtgaatatcgctttgtgtcagaatcctccttggtggtttattcatgggttggtatgtccattgtggactctgtctccatactggagtgtttagtgccctctctttccctttggagtcttctctgaagttctcccacctcacatcatcagcgccattgtggcttccaggtagccccagccttccaagacagcagtgttcccctcgcttgtgatctcaatctgactccaggaagggtgtgctggcgacttattggagctttgacaggctgccaagccacttgtcccagagaggtacctgggtgaattgacagcctggcacaggggctgttacacttgtaacaccagttggcaatcgccggattggctgtccacaatcccagtgcagccaaactgcaaagaaaacctcatctgtccctgacagagctccagcaacactggcgcctctgtgactacttggacaacacaagagatgctctgaagtacccaccaatttccagcttaacatttgaataactgaacgtctttcagtgttcattgaggggcttgtttggcaactgcggttgtaaagatgttttatattcccaagcttgattctttccagcctttgggggctgagagatgctgactccatgaacacacacattggagcccagtgtataagccaaagtcacagcaaatcagtggcagaagtctcagaactgacatttgtgcagccccttctgaaatgttttcagacaccctaatattaaaagtagggcagcagagcagatggaacccagaagtagtcagatttatgactgtacacaaaacacatgacatagttcctctgcatggatacatttttcgagttgctaaattgatcatctataaaatccagttatggtcaaaaatgaacattttgccagtaactcaagtcatttgatttaaattatgaatccagaaatagtatgctttttaatcatataaatgtcacttttgcttttgttcattcctaagagttgacagactatcccaagtggatattctgacttataagagaaggtgaagggagaaccaacacagtgcctggcacttagtaagcatttaaaagataattttttgagtggaaggagagaggtagggagggagagacatgaccttcttttgccataagcctcgccaggtgaaattcagaaacacctacctctaaccccctgcacctctccccagggcccaggcctctgagcagcactcatgggtcactttactcattgtggatcacagagcctgggctactataaaggccagtgttgcagccttctccccaggactatatttcttttcttggtgtttaatcccccctcccatgtttgatgcttagaatagcttagggccagaactaatctccctctcaaggctcttttctgtcccacaggatgtgatgttgacattacaggaccgcctttccctgaggttcattgagcactttgctcttgtccttgagtatgccgggccagaacagaatcacaagtttctgcttcttcaggacaagcaacccctggcttatgtaagtaactcttttttacagatagctttgcatgtggcctctagtagagaagacccaaggcactccctgtctggaaaatttataatgatatgctcagccggttcccagaagtcacagttctcacccaaagctggtattatccacctccagagggcttttggcagtggcctttgtgagctgagaagagcatgaagatcattagtcttggtctctagggggaagagtatggggtgattcaccacatggcacccagaatgctgagataaggagcagttgcaagtctcctgtctcctggaaaccccacatgatagatttttctgctttctgggagaaaacttggccttttgcatgaaggctgttatggaagggtcagggagtggatcctactcagccaattcccaactcccacttatcctaggacaagtgggagttgggaattggctgagtagagccaaaaataggcggcatgtcacccacatcaatttacaaggtagagtaggaaaaagtatccggtcttcctagccctcaccatatggaaaagggctggggaaatccaggattcctggatagcatttcatctacagtgaagcaccaagaagtgtcagagatgcaatcaaagccaatcagtactaccaagtagggtgggacagagttggaaaggaacagtggaagaaataccttttcagagcctacatgaaagccaaacaaaaccccaaatcagacacaaaaagatgaaaggatttttggaaagagagattcaagtttagctctcagccaaatgcaatacagagactcactggtgggaaggaaaggttgtgggagtcctgcctggagggaggcctaagcacctccctcacccccaagcaaccctttgaattcagttggtctgttgttccaaatgggattttaaacttttttattatgaaaactttcacacatacacacaagtaggaggaatatagtatcattaaccctattacccattcccaggttcaacaattatcaatacagtgccaagatgtttcatctgtaccttgaaataatattttaaacctttgatttactctaatcagcaatttactctgcttgaggctgagcccctctgtaaggtaaaggcatgaatcccacagcaagaaaagaggagtctgagccattgccaggagccctcccttcctgcctagtgtcttgggctttagacccaatggttgataaaggtcatgtcctagataagtgatttgaaaattcctcttattttgggtcagaagtgtagaaaagacctgactcctcactactttcctctgagggtaattagaatcagccaggtcggagacagagtaggaaacaacagcttagctctgccccaagccccaccttaaagagccactgagctgccagcccaacaccccagccattgattccagatctcttttcttctcccctttcatccctggaattcaggtggtacagcggacacactatcatggaatgaaatgcctcttccgaataagcttctttcccaaagaccctgtggagctgctgcgtcgggatcctgctgcttttgagtacctatacatccaggtagagtctggcttggggatacacagacagaccagtggacaaagaagcaggcaggctgttctgccatcacaatgaaatagctatgtaagtttttccaacctccaggtagccctgaaggccctttccttccttttctgctaccatcgtaggccatggccaagttggctggcctggtgacctgagctggctgtggctcaaagtcctgtctatttgtccactcagatctcatcagttttcagaaacaagcaatcccagtaactctggcatcctcacaggatcctaaagtttaacaagcccatttcggtttcaacgggtcccaacccccaatacctagctccagtatgagatgattcccaattcagtttatccagaaacatttactagacacttactctgggttaagccctatgctaggtactagcaatcagaagtgaatgaagaactgtcctggctcactagagcttatatgtgcctgaataaatatgacagcagcagggtgcaatgaagatgagggcactcaggaagcatttttccaactctacacaagagagatggtgcaggcttcatggaaaaagtgatatatgcatgctcttagccttgaagaatgaatgagagtttgttgtgtagagagatggaatggagggggcatactctaagcaaagggccttgcatttacaaagccatggtggcatg

SEQ ID NO: 4858 - DNA, 80923 bp, human; identical to SEQ ID NO: 3557

SEQ ID NO: 4859 - DNA, 78605 bp, human; identical to SEQ ID NO: 3559

SEQ ID NO: 4860 - DNA, 80923 bp, human; identical to SEQ ID NO: 3557

SEQ ID NO: 4861 - DNA, 78605 bp, human; identical to SEQ ID NO: 3559

SEQ ID NO: 4862 - DNA, 62764 bp, human; identical to SEQ ID NO: 3562

SEQ ID NO: 4863 - DNA, 62563 bp, human; identical to SEQ ID NO: 3563

SEQ ID NO: 4864 - DNA, 61676 bp, human; identical to SEQ ID NO: 3564

SEQ ID NO: 4865 - DNA, 62764 bp, human; identical to SEQ ID NO: 3565

SEQ ID NO: 4866 - DNA, 62697 bp, human; identical to SEQ ID NO: 3566

SEQ ID NO: 4867 - DNA, 62591 bp, human; identical to SEQ ID NO: 3567

SEQ ID NO: 4868 - DNA, 60802 bp, human; identical to SEQ ID NO: 3568

SEQ ID NO: 4869 - DNA, 60192 bp, human; identical to SEQ ID NO: 3569

SEQ ID NO: 4870 - DNA, 61444 bp, human; identical to SEQ ID NO: 3570

SEQ ID NO: 4871 - DNA, 61152 bp, human; identical to SEQ ID NO: 3571

SEQ ID NO: 4872 - DNA, 1140 bp, human; identical to SEQ ID NO: 3582

SEQ ID NO: 4873 - DNA, 62764 bp, human; identical to SEQ ID NO: 3562

SEQ ID NO: 4874 - DNA, 2170 bp, human; identical to SEQ ID NO: 3585

SEQ ID NO: 4875 - DNA, 62563 bp, human; identical to SEQ ID NO: 3563

SEQ ID NO: 4876 - DNA, 61676 bp, human; identical to SEQ ID NO: 3564

SEQ ID NO: 4877 - DNA, 62764 bp, human; identical to SEQ ID NO: 3565

SEQ ID NO: 4878 - DNA, 62697 bp, human; identical to SEQ ID NO: 3566

SEQ ID NO: 4879 - DNA, 62591 bp, human; identical to SEQ ID NO: 3567

SEQ ID NO: 4880 - DNA, 2083 bp, human; identical to SEQ ID NO: 3591

SEQ ID NO: 4881 - DNA, 60802 bp, human; identical to SEQ ID NO: 3568

SEQ ID NO: 4882 - DNA, 60192 bp, human; identical to SEQ ID NO: 3569

SEQ ID NO: 4883 - DNA, 61444 bp, human; identical to SEQ ID NO: 3570

SEQ ID NO: 4884 - DNA, 61152 bp, human; identical to SEQ ID NO: 3571

SEQ ID NO: 4885 - DNA, 15626 bp, human; identical to SEQ ID NO: 3596

SEQ ID NO: 4886 - DNA, 100779 bp, human; identical to SEQ ID NO: 3597

SEQ ID NO: 4887 - DNA, 101314 bp, human; identical to SEQ ID NO: 3598

SEQ ID NO: 4888 - DNA, 1506 bp, human
tctcttcaggcgtgttaagcagcggggttggcctgtacttcctctggccctggctgaagaggtgaggcctggtgggagatgtcctagggtaggacaagccggtcagagggtcattaggagggtcttgtcagaggtgggagggcggagaagacagatgaggggaggggctaaggaggaggaaagaaacctattggctgctccatccacacagggctagtgaaaccgttaagcccctaggcgatcatggccttgagacctgaggaccccagtagtgggttccggcacggaaacgtggtggccttcatcatcgagaaaatggccaggcacacgaaaggccccgagttctacttcgagaatatatccttatcctgggaggaggtggaagacaagctcagggccatcctggaggacagcgaggtgcccagcgaggtcaaagaggcctgcacctggggcagcctggccttgggtgtgcgctttgcccacaggcaggggcagttacaaaaccgcagggtgcagtggctgcaaggctttgccaaactgcacagatcagctgcgctggtcttggcctcaaacctgacggaactcaaggaacagcaggagatggaatgcaatgaggcgaccttccagttgcagctaaccgagaccagccttgcggaggtgcagagagagcgggacatgctgagatggaagctcttccatgccgtaagatcccccgaatggtccctgtccaatgcctctgccctgccccaacctgtccggaccccctgccctgtccccagaatgtgtttcagctctgcctacttctctccaggagctggcacctccccagggacagggccaggctacagtgtttccaggcctggccactgccggaggggattggacagaaggagcaggtgagcaggaaaaggaggcggtggctgctgctggtgctgctggaggaaaaggagaggagaggtatgcagaggcagggcctgcccccgcagaggtcttgcaggggctgggaggaggcttcaggcagcccctcggagctattgtagcaggcaaattacacctttgcggggcagagggagaaagatctcaggtcagtacaaacagccatgtctgtcttctctgggcttgggtccacagtctcactggagcctcttcctgtccagctccctacctcattcacatactcatacccatgccctttgtccgccttctcagccatacccaatatacccccttcaccagcaaaggtcacagaacgggttccaactcagatgcctttcaactggggggcctctgatgctagcctgtggtcagatgtggaggcccagggaatagaccctcaagagcccccaagagacaggagagactccgaactccatcagcagagaagacctccagtatatcgcaggccagggaactgggactgcccgtggtgtaaagctgtgaatttttcatggagggaaaattgcttcctctgtgggaggcgaatctggctgcaaaagcctcagtaaa

SEQ ID NO: 4889 - DNA, 282281 bp, human; identical to SEQ ID NO: 3605

SEQ ID NO: 4890 - DNA, 282281 bp, human; identical to SEQ ID NO: 3605

SEQ ID NO: 4891 - DNA, 282820 bp, human; identical to SEQ ID NO: 3607

SEQ ID NO: 4892 - DNA, 225680 bp, human; identical to SEQ ID NO: 3609

SEQ ID NO: 4893 - DNA, 282539 bp, human; identical to SEQ ID NO: 3610

SEQ ID NO: 4894 - DNA, 282823 bp, human; identical to SEQ ID NO: 3611

SEQ ID NO: 4895 - DNA, 283865 bp, human; identical to SEQ ID NO: 3612

SEQ ID NO: 4896 - DNA, 282281 bp, human; identical to SEQ ID NO: 3605

SEQ ID NO: 4897 - DNA, 282281 bp, human; identical to SEQ ID NO: 3605

SEQ ID NO: 4898 - DNA, 282820 bp, human; identical to SEQ ID NO: 3607

SEQ ID NO: 4899 - DNA, 170788 bp, human; identical to SEQ ID NO: 3608

SEQ ID NO: 4900 - DNA, 225680 bp, human; identical to SEQ ID NO: 3609

SEQ ID NO: 4901 - DNA, 282539 bp, human; identical to SEQ ID NO: 3610

SEQ ID NO: 4902 - DNA, 282823 bp, human; identical to SEQ ID NO: 3611

SEQ ID NO: 4903 - DNA, 283865 bp, human; identical to SEQ ID NO: 3612

SEQ ID NO: 4904 - DNA, 171855 bp, human; identical to SEQ ID NO: 3613

SEQ ID NO: 4905 - DNA, 3939 bp, human
gacagcctcttcccccaaccctccctttcctgaattccccctcctcctcgctcaccttaaaaccatcgtgcatcaccatggcgagttgctccttcactcgcgaccaagcgacaagaagactaagaggtgcagcagcggcggcagcggcagctctagcagcagtggtgaccaccccgcttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctgaacaccgaagtggccagcgtggtcgtccagctcctgagcatccgtcgctgtggacactcggagcagtatttcttcttggaagtaggcaggtccactgtcatcggtccgggagagctctggatgcaggtcgatgactgtgtggttgcccaaaacatgcatgagctgtttttggagaagatgagagccttgtgtgcagacgaatacagagcccgctgccgcagctacagcatcagcatcggcgcccacctgttaaccctgctgtccgctaggaggcacctgggcttggtgccgctcgagccgggaggctggctcagaaggtcccgctttgagcagttttgccacctcagggccatcggcgacggggaagacgagatgcttttcaccaggcgcttcgtaacacccagcgagcctgtggcccactccaggcgaggaagactgcacctgcccagagggcgcaggtcaaggagagcggtttcagtgccggccagcttttttcgccgcttagcacccagcccagcacgtccccggcaccctgcagaagccccgaacaatggagctcgcctgtcttctgaagtgtctggttctggctctggcaactttggggaggaaggcaatccccagggcaaagaagatcaggaaggaagcggaggtgactacatgcctatgaacaattggggctcaggaaatggccggggctcaggaggtggccagggctcaaatggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtggtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctctaccaaacccttttcggagctcacctttgggacagaatgacaacagtgagtatgtgccaatgttacctggaaagttcctggggaggggcctagacaaagaagtctcctataactgggaccccaaagatgcagcttcaaagccttcaggtgagggatcattctcaaagcctggagatgggggatcaccttcaaagccttcagatcatgagcccccaaagaataaagctaagagacctaaccgactttcttttattacaaaaggatataaaatcaagccaaaaccacaaaagcccacacatgagcagagagaagctgacagctctagtgactacgtcaacatggacttcactaaaagagagagcaatacaccagctccctctactcaaggactaccagattcgtggggcataattgctgaacccagacagtcagccttttctaattatgtgaatgttgagtttggagtgccatttccaaatccagcaaacgacctctcagatcttttaagagctataccacgtgccaaccccttatctctggacagtgctaggtggccacttcctccccttcccctcagtgctacaggtagcaatgctattgaggaagagggtgactacattgaagtaattttcaactcagcaatgacaccagccatggctcttgctgacagtgccattcgctatgatgctgaaacaggtcgaatctatgtggtcgacccattttctgagtgctgtatggatatttctctctcccccagccgatgttctgaaccaccacctgtagctaggctgctgcaggaagaagagcaggagagaagacgcccacaaagccgttctcaaagtttctttgcagcagccagagccgctgtctctgcttttccaacagacagcctcgagagagacctttccccatcctcagccccggctgtcgcttcggctgcagagccgactttagccctcagccaagttgtagctgcggcctccgcgctcgccgcagccccgggcatcggcgcagcagccgcagctgctggatttgactccgcctctgcccgctggtttcaacctgttgctaatgctgctgatgccgaagcagtaaggggagcccaagacgttgccggtggctcgaaccctggagcccacaacccatctgcaaaccttgccagaggtgataaccaggctggcggggctgccgctgcagctgccgctccggaaccaccacctcgcagtcgccgggtgccaagacccccggagagagaagattctgacaacgacgacgacactcacgtgagaatggattttgccagacgtgataatcagttcgactctcccaaaagaggtcggtaattttagaattaatttccctaaagtgaatggtcattgtctaatgattcgatgcgctacagtctacagtgttagggatactatttcatta

SEQ ID NO: 4906 - DNA, 431 bp, human
ggctcgcccccccgcctcaccgggtcagtgaaaaaacgatcagagtagtggtatttcaccggcggcccgcagggccggcagaccccgccctggacccctcgcggggacaccggggggcgccgggggcctcccacttattctacacctctcacgtctcttcaccgtgccagactagagtcaagctcaacagagtcttctttccccgctgattccgccaagtccgttcccttggctgtggtttcgctggatagtaggtagggacagtgggaatctcgttcatccattcatgcgcctcactaattagatgacgaggcatttggctaccttaagagagtcatagttactcctgccgtttacccgcgcttcattgaatttcttcactttgacattcagagcactgggcagaaatcacatcgcatcaacacccgccg

SEQ ID NO: 4907 - DNA, 73 bp, human
accacagccaagggaacggacttggcggaatcagcggggaaagaagactctgttgagcttgactctagtctgg

SEQ ID NO: 4908 - DNA, 109166 bp, human
tctgcggatgctgaagagtgattttcaaaacatttactaacgctttcaattatttaccccattaatggaatttgtcaacagactggagtccttgacaggattgtgaatgcatagaggatgcaaagaaatggacacactgaggtagctatgccagtggtctgcatgcgcaggcagtaaactgaagacatttgagcggtgaattacttggtgagtagttgacagctcttgtttataagaaagattgtaatggggggaaaaaagacacagcccacctgggagctgagacgctgattgagatacattagttttactgcaatatgtagtaaaaaaaaaaatttaaagaatgaaggaaagaaggaaagaagggttaaagagagccttcgagatactttaagtcaagatttgagctcaaaggctctcatccaagctttcgtttagtttctctcatgattctttttttattgcttcctgatgttgtcttatacaagctgttaacttgattcaggctgtaattagaaagacaaatcaatctttcatagaagtcctcggcttgacaagctggtatgaggagccatttccctcagagctatttgtcatagtctttctttgtacatgtttaacgaacggtggttttctgtgtgaagccaggcttcccatcagattgtaaaaactacctgaaatgaaattatgcatccctatgctctagccgctttccatggaagtctgatcccatgcaggtgttcacacctgagtaacctaggcaatggccccagaacaactgtgggccagtagtattctatttccaaaatttcataccttcaaactttgttttagttatatccacatttcccattaaccccaggaaagactttagtgagctaatttttttccttaaaccaaaatcagcaggtggaggtttagggcatcctccccctatcttgcccctttctttccctccctccctcccttccttccttccttccttccttccttccttccttccttccttccttccttccttccttccttcttctctcccttcattcctccctccccttctttccttccttctttctcttcttccctccttccctctcccttcctcccccttcctcttttccttccttctctcttcctcccttccttccttccttcccttctttttttcttttttcttttttaaagaataagtttccttctgtaaaatcttgagttgggggatcaagactaaatcctacagcaacataaaactttctggttgtccagggagtcctaacagagttagaaatatcaccaaatgcatcacatcggtaccagaaaaaatgtaagggcagaccttcagcttgggaaatgtttatcttgcagttaacaaagggaaaagagcaacaaaaactgagagtgaatgccaagggacactttgtggcatgtggcctgaggagggacccgtgttgtatgaattttagaaatggtataaaaaatctaactttttagaatttggggtgggcattgtgcttaggagttacctggattataacacaaaaatgccagccttacacctagaatggacagttaatcactttgatctgaggggcaccaaaagtttcttcatttttttgctcaaaaagtagtccatcctcctttgcctacctgcaactgatgcttgaaatagacattatattattagagattaattattttggcataaacttctccccagcccttaagagagaacaaacaccactggttggggaggaatacaggaaagtgtcaaatattatcattcatttacatattagtgcaaatcatttaaagagtttctttctttagagttgttttctctccattaacgagagggcagagagagctgtgctagaagtctgaagacaaactttaccccttgataattttgccaaaggtgggtcttgattaaggcctaaaatagagcattttaaataacatggtaatacaaaacattttatttgtgctccatatctcctcttcagtattaattcaacatatattttttgcgcacctactatgtgtcaggcactgcgaagggcactggagatttaatgttaagcaaaagcaagcagggaacttactaacttggttttctccctcctgaggtacatgcttgcttttcttgtttagatttcttggccaggcccttatactctcccattttttttttgtagttagtcttagcacagaccaacttctcaacgtgtgtttgttattaatgataataagataaccagtgattttaggagcccaggttttcagtgtagcataactccagcattgtcggggagtggggtcttcacatcacagaagcttgacagaggattccaggccaaaattaaaaatgatcaggaactggatctaccagatagaagcaagtactttgggggaatccaactccagtgagaagctaattagagcagcaaaggctagaaaatgttgaatgaactcagcagtttcaaagtgcagaggtttagaaaagtaactgcctagacaaagtacagaatcccaggatggatggaggtcagagaataaagggacttgctgatctgctagtccagctaaaggggaaaaaggagagacctagagtaggcaacaatctgttcaggtcacatggtgagttggtgcagaattgggtccaggaccctggccttctgattcccagtgcagtcctctttccaaatagggaggaagaaccagtgtttattgaaagacaactgtgcacttagtattctaatttatttacttctttatctcaaaatgattaaattaaatttacccccactttgcagatgaggaagttgaaaattggggctaatatgctgaagggtgtaccctcaagatttccattctcaaagattaggattagctttacatagaatacagtggaactggtgctccccacccccagctgtgcagcactgtgccctgagtgaggagtcagtgggcagtcccagggctaggcttgaacactagtagcaaattacttctggttggataatgaatttcttggtggctcctcccaatttactctgcccctccccaactctacctaatttattctttcatgggtgactggggaacttctttaaactgcaaatgaatgattcgaactcagtttgagtaacatagcaggtataataatggtagtctcattgacttcatagatgaggggctatctgcagaacttctatctagcacagggctcaatcaactggggtgcaaatctccattctaccgtggtttgcccttaggcaagttacttaccctttctgagcctcagtttcatcatctgtaaatagtgatgataataacacctacttcaaaggactgtgatgagttttttaaattcagtttttaaaatgagacaatacatggaaagagtgtagcccagcatttgacacacagcaagaactcagtatatcttagactttgttagtctaagtgctaatttctggattaaatgcacagatactgggaaggaacccatgaaactagtgtgtttggggaagaagaggcagtatgtcggctttcttgccctgttgctgtgaatagggttttgtttcccatatagagctgtcctcactgttgcacattcctagtggtcaaaagagtgaggcctataaggacagagagataatgtagttcaatatccttgtcacaatacagaccagaaatagagatccttcccatattactccagatgagtggctcctacagtgtcctgcctcccaaattttgccatggcagagaaaagagggaggctggaagaagctggaagagaagcttgtggctcttgactagagctcagctctgggttgggagctctttgaagcctgagtcaacacctcacacttcatccatcctgtatctcactctcatgcattcaacatagtgcacagaatagatctaattttttggaggcaggttagactggattatctttgagggcctaggaataaatttgaggctcttatgcatataatcagctcagaatcatctttccactgtccccaaagcaaagttagaagtcctcccccatcccacacacccctcagccactggcttatgttgttttgtgaactgtttgctcccccaagactttcttgactctcattcaaatcagctttcaccaatatacgaatgttggggcatactatttgtggtaggtctttaagattcactagatatgcctcagattggtctcttcaggagtcaaggtttctcataaaattaggagtgagagtcaagataataaccaacagggctggcacagacagaattgttgctgcccataaacaaccagtttggcctgattggtgcacaccagcgctgattatcagccctgaagaaagctatgccattattttgatctttgattagaattaaggatttactaaggattctccttattaacatctctgtgacctatctttaagtgttgtggggtctcagggttttgtcctttgtcttctttctttactccacaaaaggcatgttttaaattaccctctatcaattgattacactcaaatttataactcttattcagctttctattaagaatttataactcttgttcagctttctatttttttcctaggccctccagtatgtgctgttatctactggatattgccacttgttggccaattcaagatctctatcagaatgcatcgtctctcccacctccttcctccagtgtttcctatctcagagacttgtgccattttccaatcagtttcctaggtctgaaaagctcaaaatcatcctagagtcctcctttcttttcacttaccttctatatcttgtcagtcaccaagttcttgttatttctgttttcttaatcttgatatttttaatcttggaggagatgatcccattcctctaggtcttcactaccactctcttggtctgtcatcatttctcatatggattattgtgacagactccaaactggtctctttgcctccagtcttgctttcttccaactcattctccacattgttgctagagagatcctttaaaatggaaatctgataatactatttccctgcttaaaaccattgggtacagtattcaatcatggcatatcttggtgatctggcccttgccttgtctgacatcacagactcaagcagaacaaatgctttagaattctaagaatccatatatatatgtatacacacacacacatacatatatacacgcacatatatatatacacatatatatacacacgcacatatatacacacacacatatatatatagtctgtctatctatctatctatctatctatctatctatctatctatctatctatctttacctctgggtctttctgcatgttgttccttctgtttggaaggctcttagcatcttagcaccaaactactcctgcaacttcattcacctggctaacttttcttcagtactcaatccagagagactgttcttcctcccttctctcctcccctgaaatctgggtttaggtgatcctctctgtctctctgtttgggctacctcaatcatagcactttttactctgcattgttattatctgtttacatctatttctctccaagagagctgtatgggagagaaaaatggacatattgaaaactataataatgatactatgtctaatataatgccaatgacttgccaggctctgttataagcacttgccgtgtgttaactcatgtaattttcaaaacactgtaaggtgggcagctattactgaagttgaataaataggaattggtgatagattgaatgtgggggaagagaaggagtctcagtgatttccagttttctgaaagaagcaagtgggcaaacagtggatggatgtgccatgtactgagatacggggtacaggaagaggaggagttttgtcaggatgggggaaagaaacttttagtttgggcactgccattttttttttttttttgccattctttcacaaccgatgatttccagaagcttcagaaataatgtgagtaacaaaccttttcctctgattgacaggcatttggaaacaccaccgtctgtgtcgggaaagcagaataactctccagtatctcgtcattagcttgctggaagcaggagggctatgttcctgggactcgggcgcttttctcgccttgttctctggtttgcggctttcaggaaactgctgggacaccatggccttgcatctgccaagttcctgtggtgcttgtgccttctgtctgtcatgtcccttccgcagcaggtgtggacactcccctacaagataggggtggtgggcccttgggcttgtgattcgctgttttcaaaggccctgcctgaggttgctgcgcgattagccattgagcgaatcaaccgggacccatcttttgacctgagttattcttttgaatacgtgattctcaatgaagactgccagacttcgagggctctctccagtttcatttcccaccaccagatggcctcaggatttattggacctaccaaccctggctactgcgaggcagcctcgctcctgggaaacagctgggacaaaggaattttctcttgggcttgtgtgaattatgaattagacaataaaattagctacccgaccttttctcggacactcccttctcccatccgggtgcttgtaactgtcatgaaatatttccagtgggctcatgctggagtcatttcctcagatgaagacatttgggtgcatacagccaatcgagtcgcaagtgctcttcggagccacggcttacctgtaggggtcgtcctgaccacaggacaagacagccaaagcatgcggaaagccctccagaggattcaccaggcagacagaattcgcagtgagtgctttctcccgctgaaatttaaacgtgacttcagggaaagagattacaatctccaaaaggtttcctaccctcacaccctagggtagcacatcccttcccatttctttacacatttgccctttttcactcacacacaggtcccaagactgccctgcttcaacagagcctattttatgaactgaataacagtacaaagaactctgtgcttcatatgcctgtgaatgctagtgcctgctcttagcgcctgagtgaagaatggtgtcaagagcactgtagccatacatcctttctttctgcccttaggaccttggtagcttcgaaagtgccaaaatggtatggggaggcgcgggtcttcttatggcttcatttttgtttgttctagtcactgaggagagatttacttttgactcccttctggatactttccttcaacggtacccagtgtccttgtgggacacttacttagaatctgtcttctgtggactccgaaatgtccataccttctgccttttctcaaagcagggcttttctttttgcagcacacagttagttgatatggggggcacctagctgatgaatgaaagcatattaaaatgaaaagactgtctaaattttaagtttccccttccaatggaagcttaatgttcaaagacgattcttgcagagacgatagacaaaatgtgaagcaaaggacttgacccactaaagctatcattctcaaagttagttgggtgcattttggcaaaagggggccctttctggtcctcttgaatcagatctcttttactcacacttatggcaagcccttgtgacacctagttttgattttttctattccaattttttaacctccattttaccttcctctggagatggctatgattcatgggaacgctgctcattcccccactgcagccactccaccactttaggatggatatctcagaaactatttgacaaactgattccttcaaggattagtcctggtcccagtcatttccttaaccattgttaaggaaatgtttgttagagaatggtccagcttaggcctggcctataatcagaagcctgttttaagtttcaagtggcttcagtattggaccttaattatgatgatcacaagaggatgagggcaagaggagtttttagttccagaactacagtaatctgcctccagctccagttgacaagattccgtgatgtttagcaatcagtatggctctgattacttcataatagagcttgatactttcaaagcagagcatagaattattttgaaagacataaaatcatttgcaggaggagccatgccagaaacaggctaatatatttagtatcataactttataataggttacaaatcttcttgaagcccaatgtctcctgcaagtttatattccatgaatgtttcacatcccacccatttgtatactttgaaatgacattttggcctctaccataaaatgttaaataaatccaggccctgaagctctttgggctgccagactgagaagaattaggattgagtgctaaccacccacaacccctttgaggcagggagggagcaaatgcacatattattgccctaccattagagattcctttacgtcaagggttctcagtgtggctgcatgctagaattacctggacatcttttcaagaatactggtgccacagcgccacctccagaaattctactagaattggtctgtggtgggtcccagcaaaggtattttaaatagcttcccgggcgcttgtaacgtgcagccagagttgagaaatgctgctttcacttaataataatcaaataaatatttcttgctttaagttcccattgttttaatatgacttcgcttagtcagattgttttctttattacagtacagatctgctcactaagggaatggaaattttgaggatgcagagaaaaaaacccagagaggatggttatggagcaaacgaagaccttgaatagcaaggacagcaacaggaagtggaggagggattcagaaagagagattaaagggagtgaagacaaaagctctgcactgcaggattttcctttgttttttgacaaaacataggcagattcagatgaggcatgctgggacctcagtgacatgagtcagaatgtgggtggggtgggggcaggggaactgagccattggttgggctgtggcctgagtacaacctcaggcagctcactgtgctttgttcaaaggagtgtgtaatacccatacatggtacaggcacatgtctgtatctgagggcatgccaactggtgggtgaggtgtgacagggggaatggtggaaggggagtgagtgttaaagtaagatagaccttgcccttgttgtccacttgatcatttgttggaaacaatgccccaacccatgggaacatgtaaagcaggatccagagaatgaacaaaaatagattatcagagctttagctaagtggcctaagggtcaggccacatcttttgtcccattagaaaattggagatttggtgagaaaccaagccagaagccagtgagtacagattgggtcaacacatcagtgaggaagactgcaacacaccatccgtagcacataccggatcaaatctttagctaattttccagctcctctcaactgctgggactgaggctgctaagtattcctggatgttatctatctggactgagaagaactaaaaagacaacaaactttttgtgtgatctcagctgagaaggtctgaggaaggcagagcctgacttcttccctacttggctggatttgaggctactttttaacactgtggacccccaagcaaaccttcagagaggacactttgtgacatacaaaatacagtggaaagggaccccttcctttggaggggcctagaaatatttggaagtagtaggaataattgggaggtttttttttttttttcctgatctgttcgcaaaagcagtgatggcattgccacgtggccgtagcagtggtggttgtagtgatggtgtgggaggggagagaagagcagcctattactggctggtatgacacttctggttcttataagttaatatttccaattaggaactctcattggcaacttactggagttagaggaagcgcctttctcagaaacaggtctaatttgcacttacataatatcaatgcaatgatagatttaatagtaggcaataatagcaataataatagccatgcactcttgggtgggaaaacagcagaggtgttactatatgctgccatagagacaataaaagcaaccatactattactttacgtgtaaacagctctctacattttacaaggcatttgcacatagatctcaattaattctcaggattatccaggagataggcattttctttcaagttttacaatacctgtgagtctcacagtaataagtacatatgtgtaagcactatcaacactaaagaaggaataaataaagtctcagagtagggggattcagcctctcccagattctcaactcaattctcttaagccttgggagcaactatttctttgctttgacaaagtcaaataggagagttattaatcaaagacaaaggccttaatttatagtcagggctgctgtgtgtggttatgtaggttgtgccctgcacaaggaaacctagctgattggacttgagggccaaaatccagtccagtctctgctcctcaaaccatgaaccctgttggaagtttttgtccaatggcacaaaaggtcatttacttaccaagcagggcacctgtagggttgcattcattcaggaggggttcctcttctaattcctgcgaaggttagcaggaggccctacctgcagctctttagagaacttttcaaatggctattctaagccctctcttctcctcgccttcttgctgatcagccctgtgcttggctgattgtataatcctttcaatctgggcttaccgggatgttggaccatttgggatttcctttcaatccttccaaattgggaatgcttcattacaacatgatgttaagtaaatatgacaccattggaatagccttctcttgctcttccaaaattaggtacctgattgctatcttattgcctgggacagaatggcttcttctcatttattgaagattcttgtatataagaaaaagatagcaataaaaataatggtaatagttaatatttattgggaatttactatgtgctagtaatttttcaagggctttgtatggactatgtcatccaattattgcatcacccctattaagtaagggcaattattgtttacctactttatgaataagacttccgaagctaaaaggggttaaataacttacccaatgtcatacaactggtgaatgagaaagccaggatatatattcggagtagtctaaagcagtggctctcaaatctcagtgggcatcagaatcccctggaagacttattaaaacacagattgttgggttcctcctcctgagtttctggttcaggaatgctggtgtggggcccaagaatttgtatttctaatactgcacattctcaggtgacactgctgctgctggtccacggaccacactgagaaccactggtctattgatagaccaatactatactacctcctgaagcatactcacttgagatcctgtgttctatatgtggcatataattcagcccttccacctttctttcttaacttttggacccatagatacaattcttttatgtgcctcaacgtaccaggtgtcagccctgttttcctatactgataacaacagtgatactgataatactatgactaggagccttagcatcaatagggaatttggtataggatttggtataatgtaacaccaaatgtaagtaaatataaatggcaagaggacaactggctttcatgaatggcaaatgatcactaatgatcaaattattgaaggcttgacacaagaggaaatctctaaacatctagacttcttgcatttaagaggccttatgtacatagcagtttaggaaaaacaggaggaaacatatgtttcaaggtatggagaaatataaaaccttatctcaagctgggcagcaatgttaaggcaacattgctgtacaaattgcaatacaagtttgagtgtggaaaaaaacatggtctgatgcagatggaatagtctttgaatgttatatttgtgtgccatcatgctgagctacttggaccagttcaacaccagtggtagttaagtaagtggtagcttcaggacttatggccaaaaacgtgtggggtatccttagctgatagagatagccacacatcacctagtatagtgttccaaaagtctactttgagagcctcctgcactgagtcacagttggggatggggcctgggaaacatgcactttccagagcctcccaccttcctcttacacagccatttattaggctgggtgggagaaaactgagagggagagtgtaggaatgtgcttctttcacaatatggccagataggaaagaatcctgagagaagatgagacttgggataaatctgcatgctgccctcctcctctggtctgcctcccctccccgccctgttagcaactgttcaaatgaatgacagtggcaggaaatatcacaaaggggttacaataaagagcaaagacagtagaatgggggggtgtctctgtggactgtgagcaatatcgatggctcacaaatatgaatatggctcctaaggactcctttagcagcagcaagtggaatcatttccatcttgcaaggtgtgaaactgggcccagtttcctccatggaggacaccatagccagtaatctgagagaaataagtgacctttgccttttcagaaacacagttactctctctcaagaaaatatttgatataatattttaatttaggaagagaaataggaattgagtgacatggaaattggcttctcccggagtttcatggcatttcctgctgctagtgaaagaaagggtcctagacagcctgctatggttggtgccacaatataaagacatagacactagacagctcaagtagctcagagaaagtgctggtgtcatatcctggtgagatgcgatctcagaagggtgtatttcctggtccttgttttgactataaagtagcttgataggatggaaacttacaaattagtattattcagtgaccacctgttgacccaggccttgtttaggatttaaggtttctgtacactaatcctttcctgacaacaacttacaggtcaaatcccattttaatgaatgtaattttaacataataaaactatttagtaaaattatcttgtagaacagatgtatctacaaatccctgttcacgaagcactcaatctattaaattaagatgctgttgtttgaattcagtatttatgctttctactttaatcatgttcaatggcaagatcttgccaggcaaaaaatagaggagcctgtgattattccctgttgagtttcctatttcttcttctataaaatgatggggacaggttggcctacttggtcttaaagggtcttttcagttataaaaattcggaccctttgaaatatggtcagtatgggtcaatgaaagaaaaataaagaggagagatttagggttgagggtaaggtactgggcatagttaatgatagtaggcatgaacaacaggcatggcagtatctacctgcccagcaaatatcacttccaattgttcctccatcctaacaatcaatatatgcccatatctcatatctcaaggaacccacaaaaaatacccaagtgtacaagctctcttcctgaagaggctgttagtttacaaacattcatctaaacaacattcattgtgtgcataatatgtacaaggatatggaaataaataagacacagttcctgacctcaaggagctcacagtttggtagtagaagctgatataggtaaataacagcaataaatcttgtaagtgccaggataaaaattatctcagggtaaggtgggggctctaatccagtgtcacaagtcagtttccctggaaagcagcctgttagatggagctttgagtgcaggaagcttactgaatgagtattttcaaggagaacacctgtgaggaagagaagacagtaggattgggcagagagaactgaactgcagtgcagccacaacaaaggcctcagccagtcttagaggggagctctagagctggtatgacccttcagagttgtccagaattgagataaggagtctgggctgttctacctccatgtggaattgtcattaggttcagtctcacccacagaaaggggcacagtgtgtaataataattgtttaacagtcagatcttcagatggaaaaaagttttgatttgtagtgtttgctgatttccatagtgtaatcactcccacagtggtcaatttcaagctaataacatgatgttaactggctcacaaaatctctgaaagttgaaccagcaaaagcgaaccccagcacactactgagaggatgtaaccttgagagaggtgcctttccttagctgaggccaactctcagagaaaagtcacctatcagctactaacacacccagcagctggtggaatgagtgcttcagtgctgaagtgtgtatcttgatggcacatcaccatagcacctactacgtgtaatgtatgttaaagtatttgctgtattgcaatcagcaccaaacactagttctatttaacattttccatgcagtaaagtcattttaatattcctttaagtaaattaaatcaaattgtatcactgttgagtaaccttgaacaaatcactcaatctctgatttgcagaagaaagatgctaatactgatctacttgctgaggatactgttggacaaactggccaaccgaagcctctgactaaactcattttccccgcctcaatggacctatgactatactaatttgaccaaactaatttacttttaatggttcagccaaatgtagagagtgagaggtcttcagttctactttctttttctaaatccaactcttgcattgtcaaacatctctggcactccattttcccatgatacaatgtgtgattataaacaagtgaggctgaattccttgtggggctcatgaactagctccaaagatatccttcgagaattctaaggaaggtctgaacatcagaatacatgtagaacctcttagcgtaattattttgaaggagttaatggtcatttgaaaactcatgtcatgttgtggtgtgtgcatatgtgtgtggtatgtttaaataaacttcataacttattagttacactttaaaaactaaaaggtaccagctctagctcaaagggaaactttctaggggtgcttagcaagtgtaaaaaggtgtttgaaaatagatgaaacaatatgcaaatgccaaagacaagtcattgaatgtagttaagcacccttagttcttgagattaaaggttccatataaacatgtataattaatatttaccagtagcaatagagtctttgcctttcttcaaggagctcagaatgcttgccaggcattatctaattaaactactcagtgtacctgtaaaatgcattggaatctacattttaaagatgtgggcactgaagcacaagtgggcttaaactaaacttatttagcatgccaagggtaaaattggatataagactttcagtctcatgatctagctgccatttttcaaccgtggcccccttgaatccactctattctagcataaccttgccaaacaacatagtttcataagtctaggaagaattaaattgagtccatagtaatttcaattacagggaagttagattttaaaaagttggacatctcacccataatattacacagagtacgtccttaatctgagaatctgaaatccgaaatgctccaaaattgaaaacttttgagcaccaacatgactctcaaaggaaatactcattaaagtatttcagatttcagatttttggattagggatgctcaacaggtaagtataatgcaaatattatacttaatatcccaaatctaaaaaaagtctgaagtctgaagcacctctggtcttcaatagtttgtataaggagtactcaacctgtagtaacatttataggtgagtgagttagtgcttttcattgtctataatgaccttggtaaggatgagaacaattggtcaaaatgtattagagtgcatgtttgtaggagatggacaataaaaagcaatagtggctgtggtaacatctcccatcctctcttactattctctcttctaattcttaggtatatagtagctactatttattgtgtgctatgtactaagtaaatgacttgtctcctttcttcaatcatcactaccatcccataagtatatattgttatctccattttatggacgagacagagagcggttaagtaatttaaaaaagggtacacagttaaaactggtggtgttacgatgtaaagctgatttttccaaccctaaagcctcttttgttatgctactccccattgattatactagttcttgttcctgtctgagtattaggctctgcagcctgtaggcatctctctcttgtcactatccccaatccagagtccatgagcatacctcagcctcagctcaggacaacatcttgcttatcttggaggcataagaaaccacttacaaattggttagaacacatttatttttcctctctgtagtttttggtactgtgctttactaacagtttgcttccataacctccttgctttgttggtttcagtaatcatcatgtgtatgcattcagctttgattgggggagagactcagatgcatctcttggaatgtgctcatgatctgaaaatgactgatggaacctacgtctttgttccttatgatgccctgctctacagtttaccttataagcacaccccctaccgggtcctaaggaacaacccaaagctccgggaagcctatgatgcagtgttgaccattacagtggagtcccaagaaaagaccttctatcaagccttcacagaggcagcagcaagaggtgaaattcctgagaagctggagttcgatcaagtaagtacacattcataggttgtcatgagctgagaacctaaaacatcagcatggtaaattattttcagaccaacagtctcaattccataggaggcccagtcaatggcaggcaaccacagacaaattaaaaacatctttagtttgctgaaaacatttgtgaaacaaaggcatattatttgagattttgttcttttatctttaagcagcccacgatgacattatatagtcaggaagaataaatgtatttaagaacagataaacaaaactttaatatatactggtgctgttcaagggagcctaataaaaataagtcctgtttgtggtgtaagttctgaattaatttaacaataaggcaaaagagctagtatataagaaactatttcctttatttttgataacactggtattggaggatgcggcttctacctgtaggcatttgagcttcccaatactgaacccaaggattaaacaaacttctccatctggccaatggcattgctggaccactgcagtcctgccccatgagggcaggtcttttttaaaatgtgtagtctggagaggaacagcagagcatttgcttcttttaggtagtctgctcccaagagaaagaagacaggaggggctgagctacacatacttacttctccttccaaactaaccagtcagattaattcatttttcctttgtggggaggaatgagtaagtgggtgaagacaggccacttggaatggggaagaagtcctcccttctgatatacaagaaatagtatttatatgtgtgtagataaatgtatgtataggcatatttcagattccaatcatagccactgaaggcttagagaaagaaaaaggagtgaggaggggaagaaagtagagaaaacaatggagagcaaagacaaaaacaaagaggatgaatacaaagaagacgaggaatatgagaggaagatggggagacaaaagaagccatttagattggaaaaaatacagagggacgtttctgtacactggaggtcagatgtagaaagcagacattttcaaaagtacttagaacaacatacacataagtttaaaagctctggcatttgctagaatactgcattagtcatattgcttccagctgtaagaaatagctcaatacaaaatggtttaagtaataattctttttcaaaatttgaagatagggcttcagggttggttaattcagcagtcaatgatgtcatcaatgaaacatgttcatctttccactttacaagccatagcatgctaagcttgccctcatgagctggttcctcttatggtcccaaggtggctgccacagttccagacatcacatacgggtggcaatgtccagaggtgaaagtagagactgtctttcccttgtgtctctttttaagagtgaggaaatcggccgggcatggtggctcacgcctgtaatcccagcactttgggaggctgaggcgggtggatcacgaggtcaggagatcgagaccatcctggctaacacggtgaaaccccatctctactaaaactacaaaaagttagccgggcgtggtggcgggcgcctgtagtcccagctactcgggaggctgaggcaggagaatggcgtgaacccaggaggcagagcttgcagtgagcggagatggcgccactgcactccagcctgggcgacagagcaagactccatctccaaaaaaaaaaaaaaaaaaaaagagtgaggaaatctttcccagaatctccccaagtagacttcttcccataccttgtttgtcacgattgtgtcccatgcccatgcctaaaccaataatctggaaggaggaatgtgacaactgtgattgaaaagtgtgaacaaaatatatagctgctggaaaaatgtgaacaaaattgagattctgttagcaagaaagaagacttaggtaggcagttgattgtgtctgatattcatattcttttttatctgtcctttatttcatcattctgtgggctgcttctctgtctgaatagtgattcaaatgaaatttaggtttatgtatctctttctgctcggaggatttatatcaaatattttgctgattcttgttctaataaaaaaattaataacagagatattaacaatgctggatttggactttattgttactgataagtttataataagtattactgtcttttaggagacacacacatgcacacacacacacataactgaaaacaactggtcagtttagtcaagaattgcaaaactcaaattgctaaaaatggtcggtcaaaccagttgtttgatgtgtttataggcaagcaacaagatggtaactttttgtactttttagccaatgatatggcatcacatagatacaattaaagtcaaatttctattttaatcaaaggatcaaaggaaggaaggagagggtgtatgtgtgtgtgtgtgtgcacatgtatgtatgtgtatgtatattgttcatatatatgaacaggtattttgatataaaaactcagaccttcttctcttgatatttgcatcaatccttttgagcttgtggaaaacataaggtaattaaggcaaaaaaaagacgccattagcttggttgctaggcagcctgcactctgctttacacaaggaaatagaatagctacaacaaagaatccagagcttatgaaaaagcctgtttggatgcatttgtacccctcagtttgcaggtgcccagtctggaccttcataactgaagaatgataaaagggtgagataattatcttcatgtctctgataaacaaaaccccaattttccttaaattatcttgctcaaaggtactttagaaggcagccagtatagcagaaactgcatgttaagctctcacttttactagctgtgtgcccttcggcaagttacttagacatttgagtctcagtttctctatgtgtaaaatgggtaagtgagctatatcttctaggactactgtgaaaattaaacaaagtaacatgtaaaaagtgactgtcagagtgcctggctcacagctacctttctttccactttttctcctttgaggctaggatgaccttattgattggtggtgacctagcatctaagttacaatctttagcttcctactctcttgaagttttctgattactggcagagagtctctcaatatttccagctttcaaaattataaatggcatattctcagatcaaattatgtagtttgatatttgcctatccctgggcttctgttgtttgttccctatttggtcaacaggtcaacaactatttattgagcacctctgatgtgctaggcaatatgttgaacccaagatagaacactatacaagacagacagggtttctagcaatggtatgttagagccagtccagaaaagttgattctgtgcatcttttcccagctctccattcagtgacatcaattggtagcttgaaatcaggcatgatagtagtagttacaccgcagaaacaggcaaatgctacaaataagagttttttttccctctccatatagctgttgtcaaacacttactagcacatcactcattgccacccttatagaccttagattttagtgagagagacagataataaatggttaagcaaatgcattaacaagatggctgtatttctcccttgcccaataactttcaatgaaatagagatttctatgtacaaggagcattgcctacagcagtggtctgcaacatctcttaatttgtacccttgcttctttaacaagtaaaaaatgaaatgaacaaaaagctatcaaagcgatacaaacacatagttttaaaagtcaagaaatgctaaaaggtttatatcaataacaaagcagtctataaggcctcctttcttcccttcatcagaagcaaccactttcatatttttttagctctttattctggtatttacttctatgtttctaaatgctatgctgctactggtgactctcgattaatcaattttgagcattatttgttgtattactattatagttgaggagcactcttagtctttttgtacttccttactctcctttaaaccttaaatatggttatgtcccaatttatagttaaatccatatttagtatttttaacatagtaactatgtaaatatcatttattgctaatccacatgaaataatatggttataattcttgtcacatgtaacttcatttttaccggggttaataattacttcaatttttaatttgtttaccttaatttgaatgtctaagtctttccatactttctgataaggctgtaaaatcctgtcaaaacaattttatgcatagtaaagcctattaaataccttatgaatttcatttgtttttgctggggctctctgtcttcctattccaatctaaacattttgctccctaaggctgctgcacagctattaatattatgctagttttctattttcataattcttaaacgcctctttctttctcttctctgcaggatctatgttttatgaatctcatgacctatattcttggtttaatctgtcatttttgtggagcacatcctgtagtagctttttacaggaggtaaatttttgagattttgcatgtccgaaaagtcattatttcatcttcactattgattgatagtttgaatgagtatacaaatctagggtagaaatcattttccctcagtcctttgaagacatgtcacattgtcttccaatttccactgttggtgttgagaacaccaatgtcattcttattcctaatcttttgatacaacctatttccattcctctttgtcctctcagaaacttttaaaatgttctgtttatttctgatgctatgaaatttcatgatgatgtatgagtctttgacacatgatatgctgtattggtggagcctttcaatctagaagctgattccttctgagaaattttcttctattgtttatttgataatttcttcaacaacattgtctttcttctctctggaaatactataagatatataagatataagatgtccttggttgatcttttaattgtcttattatttatcttatatggtccatatttttgtttttagttttcctttctgggagagtttctcatctttgtgttctaacacttttactaattcttaagaatgatttagttatatttttaatttccaagagttcattcttgttgttatcaatatagtatttttcctattttcttgaggtactcattatagtttttttgaagttttcttctgctctctattttatccgttttttcctcagttcctaatttttcatgtttttatttcatgttgaaagttttccttagatgtctgcagatttgaaggtttatgtgcatgatggatatgttgacaagtgggcttcagtacagggcaattggctaaacagttgctttttgtttgcttcttttggtcaatatctgtaggccttggctcttgagctagtctttttcttcagagaagagtcttctaatcttcttgggagtcataatcatagctgtcagtattccggaagcaatgttgggaggagactgggattctcaccattaagcatgaaaactttaacttcatcactgtttttttgtgctccacctcatttccaacttccttttcgtctagtgccccagctctggagctgctctgaatcaatttaatctgtttcctatagacgtctgcacctcctggtagaggtgggtatgggggatgtctacatgtttattacacagacattcaaagagccctcgctcttttagtgtttggcctcaccttcacttctacagtacttggtggttgtaattactctttccaggattcttaaggggcagatctgcttgttgcttatcagtaattccctctgcaagcacttaggtttgactgttccccactttgctaaatcagttgccatgtttgtagcaactttttattttcagattctgtggtacagggttacagatgtttcctaataccattagatatggagatttagtgtttctgttccttgttctctttgtttgagagtgatgtttgagaggagaaagagagtgaagtaaaaaaaaatcttgatttcattatttttaatcaggaagtctatggaaagtcatgaaggaaaaaataagtcacaaaagggtgcatgtgatattattttactggtgagttcaccaaagcctattaattaagttagtaagtatttattaagctcagatttaatatgaaggttaagatcatgggttttgaaggcagactgccttaagtttacttaagctctccatgtcttcttttcctcatttttaaaattgaaaataacaatagtacctaactaatagggttcttgtgaggattaaatgaattaacacactaaatagtttgcctggcacctgataacccctcaattaatgttagccattattattattaaagttgtggttattattattattgtgggtcaggcactctgcaggggatataatagagatcaaaatagaaatgagatctttcccccaatgaaggagaacagtttttccatttcaggtgctaaggaaattggatctaaaattgggactctagtacttcttgatcaccagttcaaaactaggacaagggacttgaacattatacttccaggataatgtttccagagccctgtgctcctcttctgaaatacaaataatagcagctgttgtatattcagtgtttactctgtaccaggtcgtttacataaatgatccaatgggatcctcagacaacacctacaaattagatattaatatctacattttgtggttgaggaaactaaggctcaaggtaacttgctcaaggtcatacagctgggaagtggcagagctgggattccaacccaagtctgctaccagatcctgatcatttaaccacacattaggcttgttgtgttttattccactgtgctaataatatctaatgccaatgctttactcaggcaaagtaacattgctaagtgactaatactttgatttgaatagatttattgaattgttttcctgtaatataggaggtactagggccttatgagaacctgtgaaaagagaacaataaatcagaatagggagatctgaggggtggggacaccagtgatgaacttcttaatttagtctcaggatgattgggcaaggattataactttgtacctttatattttggccaaattagaattctgaattagggtttgatgcctacattcttccttttcattgtattcccaatgcttgttttcagttaaattctattggccacaaatgtatatggctggaacacatattttggatatttttccaaatgtacagttatttgattaagcaaaggaaatcctcaggatttcttagaaagcttggggaccttatgctctttattgctattgttttctattaccctaaatatgggtgcctggcaggggaattctaggctgcagcagatgtggttaggactggaacattccagaatggggcccaccaaacaaggttgtcagaaaaggttgcctgcagctcacagtggctaagattgtctttctaccccattctatacaaaataagggttttgtgttgatgtgcatcacatcaaacacattggtcttttatccatctcttgactatgcccaagggttgagatcatgcattattggaggtactgccgttaataacaagaattcaattatcctttggtttcttgatctgtgcatgtgcctgactttttgttcaaaattgatgtgccattttgtccttcaagtgatggcttttcaagctaggcatgttttaatgtacacttctgaggataaaattctttggaaggcggttttgtgtcttctcagacacagtaaatctgaactgatggtagtcaacttaaaaacagcacgaaccattatgctgaacaaattcatatattactgttcctgatccagaccttattctcttggataaaaactttaaaagcctcaggtagagctatctaaagtaacagaataaaaaccaatgatatgttttaattatcattcataactaattctttcaggttcaggtctatacagtaggcaaaaacaatgggcttaatcatcagtggtctcaccattttggactgtgatgtcaacaaggtcatctctctgacagaagttcttaccaattctgtcttacttttttggagctgtagtgagaagctggatagaggcctgtagagaatgcctcttcttcctgtgttccaccctttaccttttctctttctcgttatttgtggcaagtgcaactagagaccttttgtgagtgatgctaacattgtgtgcccttgatgtttgggaagaggcaattccctttgctgaagggcaccatgggtgaagcaggaactcaaaccaactacagcacaactccaaggccttgaagtgacagtggaccatcgtgacagcccctcttttgcaagtcaatgctgttgctatagctatgctataagtctctctaccatacttttgtggctgtgagtacatgtgttgtctaggctagagaatcctgaagaacaggcttcaggtttcagtcgtcttggggagtttctgtcagtcagctccaatgggtcaatcagagcacaaagaccagcacagcctggccagctgaaaacccagtgtgttggatcaactcagaggtgggaatgttgtttttgagttttaatcttcacttttggctgtaggtagatgcagtttctttctcagaaggctctgtgcctttcaaaacagaacactagcattctgtttgctttcaggagcttgctgccctgtgtgtgtgtgtgtgttttcacttatttgttttactagtattgattttatactccactttccatccttcacttattgtcataacctaccaaagcccccagaaaacagtcagggttttgcagaaattacaaagacaatcaaatacagcatccaagaatgtcaggagagggaattagtgaaaacctcttaagggagctcagcatgtgctaggcaactaagtgtggataccttggtggcagcacatgccatccattcatgatctgtttctacagagtacatcttgagacagggtgatgaaggaagatcattggaataaaaccctctggagactgaggtattgatttctgctctgctagtagttaactctgttatgtggggcaaggcttttggcctgaacaactagaagaatggagtagctattaacgtagactgacaagactcgttgtagatggatcaggaggatttggggtgaatatcatgagttcaacattgggtatgttgatttttaacatccaagtggagatataaaagtaggccattgactatatcaatctggaatttaggatataggtctgaattggaagtatgaatctgagagttatggcatagatctagtacttaaggccatgagagcaaaagagatcaccaaggaagttagtgtggacagagaagaggaccaaggactgagctgtggggcactccagtatgaagagagacgtcagcgagatgaagaacccttaaacaggctataaaaatgtctacaagctaaattttgtccctgaactataccaagtattaggaattttcacaggagttcagagccagaagggaccacaggggacatatattccaatcaagaatgctaaactaagaaacaggagacctggattttactccttattttatgctcaggtaggtgaacttgacaggtcatgtaacttctctgtgtctccctttcttacttataaagtaagatagttagacaagatgacttctaaagtttagacattcatgattctgtattctcatttcacagaggaagaaatggaagcacagagaaagctgataaatgactttctcaaacattctggcattaggcactgatcacaggacagggtatcatcttctatactgatgtcttaaaatcctgcatgcatattagaatctttgaggagcttttaataatgctgattactggggtatcaaactaaaagcatctctttttgttggtctgggttcggtttggcattgctatttttgacactcttcaggtaattctaatgtgcagctggtgttgaaaactcccactctacattaacaagacatggcagtgtcttgctatctgctacacctctctgcatcttgacttttatttctaataaaaaatgattcactcaattttaagcccttttttttcacatgaaggttgttacaggagcttagctttctagatcttgtgaaaccaaagtagcaagtatcagctttccctgatgctcagtaaaatggcatgaccatagctttcttgaactccatcctagaagtgaagtgacatggaaaaccatgaagccatggccgcgtgtgtgaggggccatgtcgggggaggtacagagaagggaggaattgtttgctcatcctctctacctttttggaaaaaaagatacaagattttatccaaaaataaacttacaaggttaatgggcagtgcatctgggcatagtatacaaaaacattgttgcttttaccatatttatttagcaggcatagttatgctatccaccttagcagtcttactgttttaaagtggcttcttgttgaagctttgccactttgcacaccaataggttttctgactaaaattcacattctctatactctacaaactttggctctagatagctgggtgcgtatgtgtcagggtggatgtctgcgtgtgcatacatgtgtgtatgtgtaggtatgtgtttaaaactgaattctaatgttcactttctctggggagcatgtgtctagaaaaatagccattttgaactaagacaggatacagacatggactgtggagacacattatttacagtctttccacacacacctaccactctagtagtgccagcaaaatgattttaccatgcatagtgcaccagtaattaacctggcatatttactttgaactccccttgtctattctatacttgttttcttaagtgccctttataattccaaatcattttcttagtttaggagcataaaaatatattatgtatgacttggtttgctcataaaattgtcatatttgatatatttaaagatgtgacagcctgggggaaaaaaaaacagaaaaattcaggggagaaaccaagcaagtccttagaaacaatttttttcctctgggtcttcatagctctacttcactcagatgtgcagaccataataatgaacacaggcttggaatatactctgagatcgctctagggcgaccagggctcaagataattgtaatttttaaaaataggtttcaccgttgtttggaaccatctacaattcaatttactttatcgcacaagccatgaataatgctatgaaagaaaatggacaggctggtgctgccagcctggttcagcattccagaaacatgcagttccatggattcaaccagttgatgaggacagattcaaatggaaatggaatttcagaatatgtaatcctggacaccaacttgaaagaatgggaactccatagcacctacactgtggacatggaaatggagctgctacgtttcggagggacccctattcacttccctggtggcaggccccctagagcagatgcaaaatgctggtttgcagaagggaagatctgccatggaggtaaggaatgcaaaatcactagtagtcaatttggctcagcttgggttacaagggaacctctttaggagaaggcacattttaatattgaaacactcataaaatcagttatttgcattcgagtgacatacacttcttggcactctatctagttaatttaaaataataagaacaatgagaggtactttgcagccttgaataaccatccacaatttaaaagcctccccaccactcttttcaaaaagaatcccactctttcccaaagagcttactctaaaaagaggaagacattagccttcttcttgctcttttgtaggctatgacctatgattgtttctcctgctttcaaggtcccctatccatcccttgatgtttccaaatcctgccaatcaggtcctaccacagaaataccgtacctatactctctcctctctgaactcccattgaagtaaaagtctgtacctcacagcttagcacaaaattgcttttcaattgtttcttgtgtactgattgtctctccacttccactcccaaatatattgcttgttgagggtagggaccatagctaataatttttatgctgcccaactgcccaacacagtaggtatccagtaaatacttgcagtttgattgactggtggaactcctctagcttgtggaagaggggaaactttgtccaatctctcagagccagaggggatcattggaaggacccatattgttattatgcaactgtataccatacacttttaaaaccaaatgcatctatttgaaaggggctttgatttctactttgctttaacatgatatacccaactacctcttcactcacatcatatttccctaaaaaatcttactaatctatccaaatatttagattttatggagactaatttacattctgatgaaaacactaattatcaaaaccagacttaccctcacccttgaaggagaagtaccacgtttttcatctataactcatatgggctcaggtgaattaaaaaggccttttattttatgaaggcaagataatacttaactttcacaggtgagataacatatttattctcaagaactctattgctgtccaacttaaattaaggtactcaaagttttccatttgtggactctttcctccaaagaaacactctggtcagccttaattcatgtgatttgttattgtcagagtggttagtggttttgcttcacaacagtgaaattgctttctgtgtccataaagtcaacaagacagactgtgctgagaaaaaatggaattaggttaggtagatgtggcttgatattagagtcaccagaaagcatgaggagtcactctgtggtgccctttatttactgcctctctctgataatgccattcttcctcttcctctcactctctgcaggcatcgaccctgcctttgccatgatggtctgccttactttgcttatagccctgctgtctattaatggatttgcttactttataaggtacattttttgttatttttgtatataaaaaatacaagcccatattagccttgttaatactgatttccaggaagtcctgtttcggtacaattgcctcattacatgacccactgattttcttttttccacagtggtttaccattcctacaggccccatttagagtgaagtgttttcatgatgccaagaataacttcctcagctgtgttgtcagtgttgttgcctgtgaatagatctggctctcaacacaatggtgaaataagagaactagtactttagggcctgtctactccctatcgttgttctcctttctcctagcagagtctcctataaccatctccttgcccaaatgatatgtgatgatagggaatggaattgagatattttaatgaattccaagaattaggcagattttgctagaatccaagctctagcaataatggtatgaactcataggattataatggggattaagtaaactaaaataagtaaagcacctagaacgatatgtgactcatagtaggtgctcaataaatggtaaaatctcaaccccttcccagacacaaggaactctcttgctgattgttggaagctcaggatcttcactttgatactcatgccttttgtccagggtatcacattctagatttctaccatcttgcttccttgggcaaaagttatcctgtctaatcatcaacatctttattatcatcaagttttgtcttcctctctcagatcccttagtacatgatcaaataatctaatgagctacttcagaatcagggataagtggctgaagatggcctaacatgacacctctttcctataaactttgcattttaacacttggaccctctccatactggaataattgggggaaagtgaaaaataaaataaattataaccatcccattttcccattgctaccctgcaaaccacatcattgtcacctcttagtaagggtggtcctgacaacaatatgtcatggattggtagggaatggagtgaggctgttttggtgagttgtaagaaaaaaatttctatagtgtattaaatagctgtgtgaccttgggtaagccccctaacctttcttggccggaattttcttatttgcgcaatgaagaaattggattagatgatgtttaagagccctcccagctctgatattttaataagtctgggaaatcctggattgaaaccataacagttgttactcttagtgtttaaaatgttagcatagctgtgaaaacttctattatccaatttccccagtattagaaatttgataaagtcgcacagagtcgtaggtaacttatgaattgttaaaacacttgataaagacactagttcaaaggaagtttttcttttaatttctgtaactgggacatattcctgctaagaacagaaatttaatatctttaacttagctgctgccaaagaataaagtatttaattaacatcattagattcttagcaaaaataaactctatccaatcaaaaagcttccctctctagagagatttgaggagtgacagactctgtctacctaatgccaaaacatcccatggcaatgtgggaaatggaatcactcagctgtttatgttacttgtcaaccgccgcaactgacagttttcactggtctttcccactgtatggactggttctttgggctttgagtgagcctagtctgcaattcttggaaaaggaaggaaaaaagaaaagaaaaaaacagtggggaggggtttgtttgaagcttgtgggctgaagggcaaagattggagaggaaaattattggagagggacatgattagagaggaaaatgattggagaggaaaatgagtttgagacaattcgtacttcaaatggtcacagaaaactcagagatgggaaagaggtacatcatttcccagactcacttggtccttggttcttcagctaacaaagcacaaaagataccccctctttgctgccttcctccctctctctgcccaccacggctgcaatcagaagagctgagcagctgatgagattctgtaatagacggtgattacttgcaggagagtaactctctgttccttccttttctgtatgttttgattgtttaagttttttttcagaaagaaagacatgcaaagaacccaaccaccccaaaacaaaggattctttgaactcctcctttctctctactcctctggaaccagattgcatcgcctttctataaagctctcccgcgctttgttatactaatgatgataatgataataacgatccctcatacttttataatgctttatgcttttcagagcactttcacatacattatctgatttgattttcaaaacaactctataaagcaggtaatgcaaggactattatcctgctagatagatgaggacactgagccatgaagaggataaattatttatccaaggtcacctggacctggctaattaatggcagaatctgcaccacaccccaggtctctggattgggagtccagtttgctttctactagagtgtactctgtagcatgattatttttacaggtgtgcctgttttaagacaattcaccacacatatgaaacagatcagttagggagtgatgctgtactttgccaaaagattcatgtgctctacccaagaatccactacagggctcttttaattttctctgcagggcagcagctcccacagtgataagggacatatttgttggcagacaattagaaacacgttaattgtttgtttacaaaccagtggaatcactgagaaaaactgagttgctgatacttaaagctgcagtgacattgtaaacttctccttaaagcaacttgacgaagcattttgattcagtggttgttttctccaccatggctcttggctttaacacattccacagagtaaccattatggggttatggaaaaagcaaagccaaattgtagctgtcagagcccccaagacaaaacaacaaaacgagcataccgactaatcaagattccctccaggtcttcaagttacccagtcagacctacctgactgcgtgaatacacatcataaactcctatatgtctagtaattgacctgtagaaaataattacattcactacaaattaatgggcatgtttagagagaatcgggtttaaactgtgtctgtaatgctcagacaagagaccaattcagtaaaagaaaaaaactcagtcagcctacttgtttggaatcatgtagacaaagcaaccaactgactgaatttttccacttttcaacctgttgctttggcaacacatagatgcaactttacaagacaagtgtcttatgggcagaaatctgggcccacagccagggagtaaggattcaagttccagctctgcctcaggctaggagatctcatgccaatttgctcaattttgttttgtttctctaatgtgtttttgtctataaaatggagattaatgattcttggccctggtattattaggataaatactatggcatatgagaaagggtgttgagttccttaaatgtattcagaggtgttgttttgaatgtgtccttgatgtgggatcaccattttattagcctgagataccattcccatgcagagccttcgcacctctcttttggtgcctcttcaagagcattttaatttttcttttttggtctttgtaactgcaagttgtgcgggccagggttgcttccttcttttcctgtgggtactatggtaaaaatccatgtgtgattatcctcccaattaccttgtataccttgtatattctttaagtgctatcttagggcaaattaaccctggctttgccaaaacacccagtcccttgtgaccctctgatttcatgtttgttttaggcgtcgtataaataaaatccagttgatcaaaggacccaatagaattctactgactttggaggatgtaacgtttatcaatccccactttggcagtaaggtaaggagtatcctcttcttttgctgccctgtccaacatggtagccacaagccacaaataattactcagcacttgacgtgtggctagtctgaattgtgatgtgctataagagtaaagtactcagtgggtttagaaaacagtataaaaacatgtaaaatatcttattaaatttaaaaaaaaaattaaaaaaattaaaaatgttaattaaatgtcaaaattaaatattttagatatattgggttaaagtatattattaaagttaattttacctgtttatttatttatttattttttattatactttaagttctagggtacatgtgcataacgtgcaggtttgttacatatgtatacatgtgccatgttggtgtgctgcacccattaactcgtcatttacattaggtatatctcctaatgctatccctcccccctccccccaccccacgacaggccccggtgtgtggtgttccccaccctgtgtccaagtgttctcactgttcaattcccacctatgagtgagaacatgccatgtttggtttcctgtccttgcgatagtttgccgagaatgatggtttccagcttcatccatgtccctacaaaggacatgaactcatcattttttatggctgcatagtattccatggtgtatatgtgccacattttcttaatccagtctatcgttgatggacatttgggttggttccaagtctttgctattgtgaatagtgcctcaataaacatacgtgtgcatgtgtctttatagcagcatgatttataatcctttgggtatatacccagtaatgggatggctgggtcaaatggtatttctagttctagatccttgaggaatcgccacactgtcttccacaatggtagaactagtttacatcccaccaatggtgtaaaagtgttcctgtttctccacatcctctccagcacctgttgtttcctgactttttaatgatcaccattctaactggtgtgagatggtatctcattgtggttttgatttgcatttctttgatggctagtgatgatgagcattttttcatgtgcctgttggctgcataaatgtcttcttttgagaagtgtctgttcataaccttctcccactttttgatgggattttttgattttttcttgtaaatttgtttaagttctttgtagattctggatattacccctttgtcagatgggtagattgcaaaaattttctcccattctgtaggttgcctgttcactctgatggtagtttcttttgctgtgcagaagctctttagtttaattagatcccatttgtgtattttggcttttgttgccattgcttgtggtgttttagacatgaagtcctttcccatgcctatgtcctgaatggtattgcctaggttttcttctagggtttttatggttttaggtctgacatttaagtctttaatccatcttgaattaatttttgtgtaaggtgtaaggaagggatccagtttcagctttctacatatggctagccagttttcccagtaccatttatgaaatagggaatcctttccccatttcttgattttgtcaggtttgtcaaagatcagatggttgtagatgtgtagtattatttctgagggctctgttctgttccattgatctatatctctgttttggtaccagtaccatgctgttttggttactgtagccttgtagtatagtttgaaatcaggtagtgtgatgcctccagctttgttctttgggcttagcattctcttggcaatgcagggtcttttttggttccatatgaactttaaagtagttttttccaattctgtgaagaaagtcatcagtagcttgatggggatggcactgaatctataaattgccttgggcagtatggccattttcatgatattgattcttcttattcatgagcatggaatgttcttccatttgtttgtgtcctcttttatttcgttgagcagtggtttgtaattctccttgaaaagttccttcacatcccttataagttggattcctaggtattttattctctttgaagcaattgtgaatgggagttcactcatgatttggctttctgtttgtctgttattggtgtataagaatgcttgtgatttttgtacattgattttgtatcctgagactttgctgaagttccttatcagcttaaggagattttgggctgagatgatggggttttctaaatatacaatcatgtcatctgcaaacaggcacaatttgacttcctcttttcctaactgaataccctttatttctttcttctgcctgattgccctggacagaacttccaacactatgttgaataggagtggtgagagagggcatccctgtcttgtgcccgttttcaaagggaatgcttccagtttttgcccattaagtatgatattggctgtgggtttgtcataaatagctcttattattttgagatatgtcccaaaccaaatccagcagcacatcaaaaagcttatccaccatgatcaagtgggcttcatccctgggatacctgtttccttttgtttattaattgtgactactagaaaacttaaaattacatatatggctcatgttacacttttattaaatagtgcagccttagaacagtgttgtggaagtgaatgcagtgcacttggagcaatagtttagctttgactttatgtagttctttgtttatttggactcaacatttgatggctatttcttcaagggcaacaatatattttttaaaatgttagcctgacataatgcttataatatagtaggtgcttgtgaaggtttggtgaattaaacaactagtgaaagagttggatttcaccaaaaggtcttctctggttgtgattgtaatgtaattggtgatcttcattaaaggtgtgcctctatgtcctacccctggggctaggccttgtgaaagatgacatgtagtcccagatttcaagaggattacagttaagttagagagacaaatcataccacacaagagagacaatgagcaccatgttgtacgaagaaactagaatgtggtaggacttcagaggaggcatatcagtggagggaggcttttcagaaactcagcacaaaaactgagtcaatgaaggaatgatagggtttatttaggtcacaaactggtaaccacctttgtttcaccctcacagttatttaaaaaaaagccagaattttgaaattgtgaaattacatataaaaatctggatttctgagttttctttaaaagttttaagatctgtcaaccttggatctcatcatgacaatcggctataactcagtagtagttgcgttttgtggaaaaggcgtgttctttgcagtttgatacaattcccaccactctatattgtcttatactcagcatatttcacgtctttatattacctgtctggccccataggcgaggtgtcctaggcagaggaaacagtataaacagaagcttggagaagagaatatgtagggaagagtactgtcaaagctagctagtgtgtcttcttgtgctagtatatgtggccacagtaaagacactagactgtaatttatagtatggtagtggatgtaggaaaagtatacaaatacattatgttgtcttcatgtgccgtttactcttgctacacaactgtgccagatttgagaattaattgttgtctcagtgaccaaactgctcttctgcctgaatgtgaaattgaaaggtatatttaattagttggctgggtgagaatggatttacatggtactaccctgagcagttggagtcaaattaattgttcagctgtttgatttaattttcaattataaccctaattcttacttatttaaatcatcagatctttttgtaaggttaatattgtgttcctggaaacatattgctgaaagccaaaactgtcactgtggctgaagcctacattccacccttgtgacataaaaatttgttgatattagtccccatttttggagacaccaaaggaccctaggactcatggtagtggaatttgtctggatttgccatactcaacatgccttgtataaaatttcctgccttaagtagaaagtatagatgttaaaatacaagctaggaagcaatcctaatatataacccaatactaagaaaaaagtattcacttttgtgacaggatgttttatcgagaaatggatgtttagtagtaaaagtagatgactagaagttattgtctaaatgtagcaaaatatagtaaagtttcagtcaaaagcaataaacctatttgtaaaatccccacttctttggtggtatccatgtcaaaatgacagttcatatcaattgcctagatgttttagctctaacatatcaaaatgatacacatagctcaattttggattgaatgaggcttttatttgtataggctttgcaatagtccagtgtagtctataagacctccacctatgcctcctcttttttatactgggacataaaccatatttgggtgactaaagcataccaggcctcacaaaattaccataaatagctaagcagtgctaccttcaggtaaacaaagtacctagggctttaaaatcttgctcaccatgatagtttttttcacttgtgcataaattttgacatgagaataaaaagtcatcactttttaccatatgagtgagaaaaatgaatagtaagagggctattaccgttactaagggattggtatactcttataagggatgggtagccttatagtagggaatgttcttttgtaaataaaaaaaaataaattgttttatttcattttattttttttactattttggccgaggtggaaaaggatggcattaccctagaagaacatagctcttggcctccagatcccttttggcatttggcttgtattggaggttctgatgggaaaagataggggaagcatacattttccttaattgctgtgtagtcacaaacttgcagctggctgtgcctaatcagtcaagaagccaagccaagaattccatccaaacggaatgtctgaaagtgtaaactcttagtgaatataaaattaattctgtctagaaaaattggcaggttaggagaagtcaggttaagaaaggaagtttttagaagaaaatgaatctgaagtcaaaatgtgtgtggattttggcaattctctcactttctcctttgcccttcatggagaggtctatatctcaatatacagatctaggtactcctgctgagatatgaaaataaagaatgaaagggaaatagattcctccctgaccttgctctgttggggagtgttcaggttgatacagaggttatgtgaagagtcaagttttacatcttgtctgaattttgagctgttgagatttcagcacattgcgggctgggtagagtttaccactgtcttggaactttgtgatagtcttcatagaaggagcttaactctgggctaactcaggtgtaatctttagttgatcaaagactactaaggtgtaatctttagttgatcaaagactattaaggggtagagtgttgggaagtagttaagattaatttttattggcaagcaaagtaaaataaagcataatgtagttgtagagagagcacaggactagaaaatataataccaagattcttgtcccagtcccgatgtacttctctaggtctttgtttcctaattataaaataaggatgttggagttgagggtaggggcactcctagacaataccaaaaggtaacggctagctctggattgctttaattctaagaaaggcacatttggaggtatggagaatatgaggaacctgttgacttatatgtcttcatgtgaaataagtctactggttcaattgaagatacagaggttcaattttaaaggttaacacagattgcaggtaactcttcctcttgtcattcaactgtgcagttccgagccctttcctaccagacttatgtgtgcaagttcaaaaatcaagaaatagagaatgtgacctatttaagcatcagactcataaattatatataggcatgtgatctgctcactctctactattattgctttctgggataccctctgccgttaatcttatctgcacaaagaagtatgccattcagcatagtatcacaaaaagagccactcctgagagtcagcaaggtgggatgctgtcctaggtctgctatagattttttttaaatgtcagatttttacaaacaataatcttgtaactaaataattgactagctatatgatattaggaaacttatttcatcttttttttttggtcttacttttttgtctataaagtgagggtcccagattaaattatgactggcattctttcttgcccccatctgtattttaatcctctctaggaggtggaagcacctttataattttttggtgctgcatggtggttaaacagggtaccaacactgaactgaaaaaaaaagttcagaaggatagggaaaatgaatcaatctcatgtttacagggttcaactcatatggttattttcttaggaataaaaaagaaaattcagataagctctgtgccaaatcatgagtattttggtcataacttttctttcctaatcctttcacagagaggaagtcgtgccagtgtaagcttccagattacctcagaggtccaaagtgggaggtccccaagactctccttttcttcagggagtctaactccagctacctatgaaaactccaacatagcgatttatgaggtaagatattcaacagctgtctaatctactgctttcttggatttcaaaatgaggcaatgatttagtaattagtctttgggtaaaaatactggggcttttggcaagtctttccagtttggtgtctgtgtttgcttatggactcgtttggttgacattcttagcaattattttcctcagcaacaaatctacttatttataacttcactgatctttcaactccatgtatttactatgcatgtagaaaaaagttcttgagacccaaacatttaaatgtgtctgtcactccagaagatatatagataacaatagaagaaatgactccctgagtctattgtttgtaatgagatgtctagagacatgcgtgtgcatggcagggtttggggtacccttctcttcaaattctagttgttcttcctgtacttgttatcctctgatactgagactttaaaatttattcagttatttatttttcttcacctgttctgcctcttggagtaacaggttactttctgctgctgaaaatagaaatcctttttattccactgaggtttctgtgtttcaagctttaagaggccaccctgtaccacctgatctaagatactagaatttggcaaccagaacaaatcttgcatcagagagatgaactgtttcttctcagcaggaatgagttaagcagggggtaaaagggaaactagactgcctttctgttccttctaagtgaggccttctcagtgtggtttccttgttttgtttgaagatactcccaagagcagcaaacactctcaacttaacagtaactacaaagaaagtccaaaacaggacagaatgagtttttagattgtcaaccacattggatttttcaagtgaatactcttctccattagataaataattgacagggaccttactatggtttgaatgtgtccctctcaaaattcaggtgttgaaacttaatggccaattgatggtataaagagatggggcctttagaaggtgattaggccatgaaggctcctctctcatcaatggaattaaaacccttatagaagaggattcatgcagtgtttggctaatttgcccttctaccttctgctctgggaggacacagcattcctcccttctggagggtgcagcaacaaggcaccatctttgtagcagagagcagccctcactagacaaccaaacctgttggcaccttgatcttggacatcccatccttcagaactgtaaaaaataattttctgatctttataaattacccagtactaacagactaagacagaaattggtaccagagcagtgggttgttacaaaaaaatacctaaaactgtggaagtggctttggaactgggtaatggggagaggctggaacacttttgaagggaatgctggaaaaagtcttgattgctgtgagtggagtgctaagggaaattctggtgaggatttggaagaagagatgaactgtatggaaagcctgattcttcttggagattacttaagtggtcgtgaacagaatgaccacattggtaaaaatatgtacgttaaagacaattttgaggaagtcttagatggaaatgaggaatgaagttggaaaagaagcattctttttataaattggcaaataacttggctgaattatgtccatgttctaggaccctgtggaatgtagaattcgtgagcaatgaatgaggatttttggtggaagaaatctctaggcagcaaagcattcagggtgctgaatagcttaactgcttatagtaagatgcaaaaagtgagaaatgacttaaagacagaatgtatttaaaaaaaaaacaagggaatcggaacatacagagttgtaaaattctcagccttgccatgtgaagaatgaaaaagtatgtttaggagagaaaaccaagagtgtgacaaaaaaaaagtttgataaggagattggtatggatagaaggaagccagatgctattcatcaagatgacgggagaatgggagaatgaccccaaagacattttagggatcttcaaagctgtcatgtccattacaggcccagagtgccggggccttgagggtcaaactggtttcaaagtagaggcccaggacactgatgcggtccagggcacctgtgagatcccagggcttgttgcctggggctgactcaaatctctgcttcccatatttcagtgcagggctctttggccttcccagttgtgactcagctggtccaaggtgtggcttggcctactgctctggaagatgcaagccatacatctcggtagtatccacgcggtgccaactttgcaggctctcagagtgcaagaggtatggaggcatggatacatccatctagatttcaaaggatgtcttgtacagcttcaggacccaggcacagacttgccacaggggcagggccactgcagagagtccccattagaacaatacccagtggaattttggggtctgcgccaccgcaaagagtcctcactagggcaatactcagcagaactgtggagtcagggccaccacaaagatcctccactagtacaatgcttagtggggctttgggacatggccacccttgacaccccagacctgtaaagccaccagaatgcaatgccagtctgggagagctgcagtcatactggctccaacctgtgagagctgtggcatgggttgcacccagctaagccatgaaggtggaatccactggggccttgggggcccaacacccaccccagtgtgtctgggaattggaacatggagtcaaagattactctcaagacttaagacttaatgttgtttgttttgttggattttggaattactttggacctgttacctctttcttcttgcctacttctcatttttggaatagaaatgtttatcttgtgcatatcccaacattgtatttcggaagaacatgatttgtttgatttcacagattgatgtgatgatattaagatgtgaggacattaagaggtaattaggccacaagggcttctactttgtgaatgatattaaggctcttataaaagaggcttaatgcagccttcagctagcttgctattctgtattctgccatgcgaagacatagtgttcctcctcttgggagaggatgcagcaacaaggcatcatcttgaaagcagacaacagacctcaccagaccaccatacctgctggtaccttgatcttggacatcccagcctccagaactgtgagaaatatattcctctctttataaattacccagtcataggaattctgttatagcagcacaaatggactataggccttcaacaccaacattggcatggtgtatgtttgttcagtctatgtgagggctttgacttaaattagtagcaggaaacctctggatcttgccttggacttaattcaatcaaagaggagaactgcttcaaatgtaaacttgaggtattggggaattgtcagctctactctctcaaagacctaagatagggtaatcagatggcttttgaatgtcaaatggaatgagctgatggctttagaaatgtattgacacctctgggattctgaagtaaatctccataaccttggtttttatctgtaaaatgaagggttgaactaagttctcaatcttggttgcttactggaatctccttggagaaatttaagaaatacctgctcccaggccccaccctcagcaattctgattcagttggcatgaggtggggccaggtattggtatttttttaaagttctctgatatgtgcagcctgggttgagaattgctggtctaacagatctctaaggccttttctggctgaatatgctatcattctctgattctgtggaataatttatgtgttaaattgtggtatgttttacttggtggggctggaaggttatagtgtagaattgagaaggggaaaaaataaacatctgtatgtaactggcctttaagagtctgtcagatcttttcacattttggaaggaggcagagagctaagttagttcccagaatgactattggtcagtcagatcatgagtatttctaaatggtgtaggccaaatcgtgtaggccaaatggggactttatttttacaaaaggagggtgttatgagaataatacctacacggtgaagtcaatattaggctgatggcagggtgtgaaggaaggcagctgaggctagaaaactggcctgactaaagaggactgactaaagaggttaaagaggactcaaagagggaacataagccaatcgcattaacagatgaaacaaagaagtagtgtgtcttctgaaacagtactctattaggaatgttttaaagaagacccattgtctagtttctgtttaaaataaatcaaattttctttttttttttgctgttatttcattattgtttattttcttttttttcttcttttttctttttttattattattatactttaagttttagggtacatgtgcacaatgtgcaggttagttacatatgtatacatgtgccatgctggtgtgctgcacccattaacccgtcatttagtgttaggtatatctcctaatgctatccctccccactccccccaccccacaacagtccccagagtgtgatgttccccttcctgtgtccatgtgctctcattgttcaattgccatctatgagtgagaacatgcggtgtttggttttttgtccttgcgatagtttactgagaacgatgatttccaatttcatccatgtccctacaaaggacatgaactcatccttttttatggctgcatagtattccatggtgtgtatgtgccacattttcttaatccaatctatcattgttggacatttgggttggttccaagtctttgctattgtgaatagtgccgcaataaacatacgtgtacatgtgtctttatagcagcatgatttataatcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatgatatctcattgtggctttgatttgcatttctctgatggctagtgatgatgagcattttttcatgtgtcttttggctgcataaatgtcttcctttgagaagtgtctgttcatatcctttgcccactttttgatggggttgtttgtttttttcttgtaaatttgtttgagttcattgtagattctggatattagccctttgtcagatgctggcaaaccgaatccagcagcacatcaaaaagcttatccaccatgatcaagtgggtttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctccataaattaggtattgatgggacgtatctcaaaatcataagagctatctatgacaaacccacagccaatatcatactgaatgggcaaaaactggaagcattggctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacggcatgattgtatatctagaaaaccccattgtctcagcccaaaatctccttaagctgataagcaactttagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttatagattcaatgccatccccatcaggctaccgatgactttcttcacagaattggaaaaaactactttaaagctcatatggaaccaaaaaagagcccgcattgccaagtcaatcctaagccaaaagaacaaagctggaggcatcacactacctgacttcaaactatcctacaaggctacagtaaccaaaacagcatggtactggtaccaaaacagacatatagatcaatggaacagaacagagccctcagaaataacgccacatatctacaactatctgatctttgacaaacctgagaaaaacaagcaatggggaaaggattccctatttaataaatggtgctgggaaaactgtctagccatatgtagaaagctgaaactggatcccttccttacaccttatacaaaaattaatttaagatggattaaagacttaaatgtcagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctgcaaaatgggagaaaataaattaaattttcataagaattgtcattggaagacctggaatttccagataaggtgcccggagtagcagatatagcaaaagacaggtttaggacatgccatcacgttgtactacgctcacacaaattcacacttttattgtacacacagatgcataacctttggaattgtgtgggaaaatcagcccttatttcacagatagcctttgaaatgtgaaaggaaagccagatgagcggactgccaggcagaaagagctgtgaatggcagatgcagtggggacatgtcaggatctgctctaatagttacagtctgggtgagatggggtgtggtgggcagcagtgtaaccctgacacattcagagagaacccactgaattcatcttccctcttcattttctgactactctttcctctttgcttctccctgtgttttcctctttgtctcatctttctctctctccattcatctctctttctcagatcattttttctgtcttctcacattctatatcccttgtagctctctccctgccgcctcccttccgtcaaccatcttttctttcttatcacagaatcgcagatcatcagagctaaaaaatcatctagtaagtccagaaatcacctagtaagtcctaaagaatcatctagtaagtctagctttatcagtgaggaaactgaggctcaggcagattgagtggctgttctaaggccacccttgagtttgaagcagggccaggtctaggatctagtgctctttccccttattaatacaccgtggctttagttcaaaactgatggactttaaattacttctaaaaagtttagtgaatagagtttgatgtttcttgctcttaattaaaaagtgagtgatgagtgaagtattttatcattctctcttaaaagaaaaaaacaaaacaaatagtgcatgtgtggtgaagataaaacttgcccatttcctcccttttcctcattattcatgaagtagaactcacacagactcaataaaaatttgcttacaaagtttgtgagaattatttaaatcttaaaacaaacacacacaaatctcccaaaccaaagaaagcctaacgagaggaaagagcaacaaagtaggagatggaagaccttgggtcaatttgcggctcttttactacctagttttctgaccttgggacagtcacttaatctcttaagttttcagtttctttatcaaaatatgaagggattgtgttatggatacctatgaccctttccagctctcacagttgttgatttggcatgaaaaagctctgcttagctgctcgtggcacttaataagccagacagaaggctagcccatgtttgcaatagggctggctctaggaagaaggtatcaggtaccaggtttgaggcagagtcaggactgcgagtactgatgttcaggttgtgtactgcaaaagggaactacatctaagagggtaatattcacattgtaacatatgccaatttatgcgtgagtggtaccaaagtgggcacagagattctggcttcccagcctagttctggaatgaggtggtagaagagccttctcacatctacatctatactggcactcccagctatgcacatacatcatcactggtaaactcatgtgtagctgggtatgtactatcttgactatgttccagaagtttcttgaggttgcttttctctcctgcctaatattctcagagaaccaatttcgacttctcaccccctctcctaaagcctgactccaaaggtgacaaggaggcttcactgggcagatagaatttggtgatgtgcagagcatccatgctgctagtggaatgtgctccctggtgtctgggggatgtatccataaatgagagtatggtacttgtatgtatacagccagggtgtgctgcctaacatcacagggctgccacaggctgtatgatgatatactcacaaagttaagattttttaaatttgagagaaaataccctttctaactagcacaaaggtgccatagtggctagcagtgaccatgggctcagtaacatagctgcaaaggtgccgggaaggcttttttgttcaccagtctttcccacacataggctgattccataaattttcggttagagttttattctttcagcttaataggtagcctttgatcccgctaaaggacaaagttctctgaagggtaaaacttcaagcttgtgtcaggccctcctgacttctgtgaatgacttttcgatccctgactgagagcagattttgatgaaggaaacgtagtaagaggtaaatgaagagagtgtgagtgaggagagttccataaatacgaggaaaaggcaaaggctgggatggtgggtcacaaattttcacctgtattagagtcacgtggagggcttgttaaaacacagtttgctggacctcaccctactacgatttctgatttcgttaagtgttgggtggggcttgagaattggcctttctaaccggtttccaggtgatgctgatgcagctggtccagggaccacacttggagatttactggatcaaatgctttgaccattctgctgcaggcaggcactgatccggtactacccttctgaactctctgggcactgagcctggccagtgcagttttttttcttttttttttttttttccagctgctgaaggtctctgagggccatttcttagttaaaggactttgagctccttggctagtaaatgctaatacaaagtgctggcaggtaactcggaagcctgcagcttccattagcctttgcctctggcaggtttccagatgcagtgccatagctggatatattccttaataagagagtggttacactcttttttttttttttttccagacagagtctagctctgtcgctcaggctggagtgcagtggcgccatctccgctcactgcaagctccgcctcccaggttcacgccattctcctgcctcagcctcctgagtagctgagactacaggcgcccgccaccacgcccggctgatttttttgtatttttagtagagacgaggtttcaccatgttagccaggatggtctcgatctcctgacctcgcgatccgcccgcctcagcctcccaaagtgctaggattacaggcgtgagccaccgcgcccggcccggttacactcttatttttggaatttgactgcacagtgccctctgctttattatctctacttgatgacaagttggtgcagcccgaaatggaatctccaggctgtaggtaatggatgtgaaagcactttgaaaagtagagagcattgtgcaaatgtaaggcattattactattatggagaaaaaagaatctatattgatattttttttaaaacaatttgggttggacggaaactaaatagggctttatgactgatgaatccttgaggctatgcacgtagaaaaaggttatctatcaggcgctggtgttgaagtgaaaacaataaaatagttgttgtttttaacttgacagaagccttaaaatagcagttttttacttaataagtcagaaatagacttttggaagactctagattactcacattactatggtagtacattgagcactcaaataaaaaatatttaatctagattaaagacaattggattgtgactaaagcataagacagccccccctccatacacacacacgaatggcctgtcccacgagagaaaaatggatcaaggtaaatgcaggaaacatttgctgcactacatctcccaccctacatttccctctacagacgcctcaaggcagtgggaattgcaaccactaactatcaccattaatcgcagggaacctggtgctacatcatttagctatgaaaaagtgaaatgacctagcacttcctgcagttagttaagaaaggctttgcaaagagtggtatcattccgtttctggagtctacatacttgcaattgtttccctgtcttgagtaactgtaatttttaagtttaacttctgtgcatgacctcatttcagctcagaatgcagaatgtctgtgaggtggagggtgggagagaaggaaaatgtctatttggattgctggtataggtataaaccctttatgtggaagggacatttttctaaaactgctggcaactaagtttcatcactattcattctcctccttttctttctagggtgattgggtgtggctgaaaaagttctcccttggagattttggagaccttaagtccatcaaatcaagagcaagtgatgtgttcgaaatggtatgagaaatcttcgtttatgtaaattcccactaaaataaatctgttctccaaagtaactaacatcagagctgtttaggaagaccccttaacaaatcagtgcagggaaactgcagggttgctaatgggttggtatgatcatatcatgcaatggcaaaggtatgtgctctggagtcaaagagacatgaagcactcaaatctcggctctaccatgtaagagctgtaataacttgggcaagtcatctaaactccctaagtcttagtttccttatttacaaaagggttatattaatgtctaccctttaggttggatgaggattttaagagacaatacacgtaaagcatcttgcgcatttcctggcacatagcttctttatcaagtggtagctattatgattattatcaagtaaatatcccatcaccattccaaatcttcattttccagtcacctggtaatttctatttgaaaagtggttatttccctaatcccactaattatgttcaaggagtccttggatggcttgcttaagaaagcagcctgtagataaggcagggatactgatgatccttcctaagccattttaaaatcttggctcctccttagactgagtccatacaagacttgtgaatactatcttgggtcccttcaggttcttgaaagtgcaattttaaaaggcaatcacagattgctctacatttatgaagtgagcaatttcaaatcattccaacaaatctgaatgaggcaactgctacttccagagcactgaacaagtgagaaaacaaaggaaatggaagacatgtggcctgtggaagataggacatgccctataggttaggaagagatgttatgatttggtatttttctttctttcttttctttttttttttttttgagctggaatttcgctcttgttgcccaggctggagtacaatggtgcgatctcagctcactgcaacctccgcctcctgggttcaaggcgattctcctgcctcagactcctgagtggatgggattacaggtgcccaccaccatgcctggctaatattttgtatttttagtagagacagggtttcaccatgttggtcaggctggtctcgaactcctgatctcaggtgatctgcccgcctcagcctcccaaagtgctgggattacaggcgtgagccaccgcgcccagccaatttggtatttttcttacacgtgattgtaatgcttggagatgaaggcaagataatgagacatgagtccagaagggggatcaaggtcagaactaaaatagacaattctacactggtttcgtaatccaaattatggtgccaaaacaggccaaacctgagacagctgatacactagaagtattgacccaaggtagagtgtgtccatgacatcttttttggggtagcttttaattttgacataatttcaaacctacaaaaagcttcaataataattcaaagattcagcaattgtgtacattttgcctagttgctttttattatctatttatatatttatgcacattatttttctgagccatttgagagtaagttgtagaccctatgcccttttacctctaaatacttcagtgtgtacttcctaaaaacactacagtataatgatcaaaatcagaaaatttaacattgctacaatattattatctaaactacttcccatattctaattttactaatggtcttatacaatacagctaatattcccacaggtcagtttccaatccagtctcacacattcagtttgctgtcatatctttttagttgcttttaatctgtaacggtttctcagattttctttgtttttcttcattttgatatttttgatgaattcagatcaattatttcatggactgtccctcaattttagtttgcctgtgttcctcaagatcgatttagactatgcatcttcagccggaatactacagaagttatgtgtctttttcagtgcactttatcaggaggcactttatcaggatgatgttgatcatcccattactggtgatgttaacctgattacttaatttaggtggtgtctgccaagttcctccactggagagtaactgtatttatctcattgtaattaatacataacattgggggagatactttaatctatgtaaatatcctgttcttcatcaaagttttacccaataattttgacatccattgataaatgtcgtattccatcattgtttctgcatttactggttgacattttattataagaaagaatcttctcttcttcctcatttatttattcattcaattatttatatcagtgtgcacatatggatttttattttattcaattagtatctataatattcatatcaatcaatctgtctatctaaaaccataaattcatactaaactctctaattctaatccagtgccacagtgttaattccgtttcttttttaacttttccatatttgtaatttccttctctgacagtgaaaaaactgccttcccattatcctcatgacatctgtttatgtgtttccttcactgacttgggtggccatgtcaggtatagagtgtaactcaaacttagaaagccaggattttctagaatttaccatgtagatgtgctttaatgctttttagttgaatgcttttttgaagctggaggtggatctgatcatagtgtcactgtgagtccagcactgccttgactacttatgtgtattcatgacctcaaaacgttagggctgggtaccaggatccagatggaaagcagatctttgtgagccagatatagaaaggagcagtgcacaatgggatggatgtccttgaaaaacaaacagctggagtcagaaggccacagagctgataatttccaacatcttttaagatcacaacttctgcaaaattgcgtgcaggaaaattaggctgtatctcttagtctcatgttcttccccataatgtggaactgattggcatattccctgtactcctataaaggcaaatggaaagtatcctggagttctttaaaggaaattctcagttgttagagagtgtctctttctttaagaaatgtgaagagaaggaaactgcagttgctgtgaaacaaagtgtttactttgtgaaaaaatatttggggccattctagagcctctattgagaatattatcttccctgtagccatttcttctccagtggggctgttattatgcctcagtacctcaagatcatgaccatgtggtgaaattgtatcccctgcttactgatgacgcttcccaaacaatgattcttttgcctttgttaaacacattcacaagcttttgaggctaatgccattctctgttttagcatcttctacacctcctgttacttccatctactctccatattcgctacccttaatttattgaatattttgggatatgtatcatggtcctcctctctactccaagacctgctgttatgctggtgacatcaattggacatggactgtggacaactatatatcttgactatttcattctttgccatatcatcctaataatcttctcttccattctactttggccaaacactgctaccattatattaataccttctgcttttccatcttctataactgctactgaaaatgcttcacctggccgggtgtggtggctcacgcctgtaatcccagcactttgggaggccgaggcgggcggatcacaaggtcaggagatcgacaccatcctggctaacacggtgaaaccccgtctctactaaaaatacaaaaaaattagccaggcgtggtggccggtgcctgtagtcccagttactcaggaggctgagacaggagaatggcgtgaacccgggaggcggagcttgcagtgagccgagatcacgccactgcactccagcctgggcgacagaccaagactccgtctcaaaaaatagaaaaaagaaaatgcttcacctcccaaattatgaattcatcacactctctgattacaacctccttttatcccaactgtgcctatatttgactatatcaggtcttccagtctactgacctctgctttctccaaactcacaagcccttgttttatttactttattgtccaattcagagtctatagtctatcatttgaacatgttcttattaatatttctgtctttttggtcagacacacttgcaaaactctagttctgtatgatcccaactcttaactttctttgtgcttgcacttgaacagccaaatattgtagcagaaagttatgcagcaaagtatattgtttccactataaattcatggtttcttatatttaaatgtcccttactactacctcataattccattatacttcattggttaattcacttcctaccacccatacatcaaagcttctccattttccttgaagctccaatgtccttctctttctcgatttttactattagtatcctggtccaagcaccatcatctcccactagagctactaagattgtctttttttcttttcatagacttaatttcttaaaaaaatttatttccatagttttttggggggaacaggtagtatttggttacatgaataagttctttagtggcaatttgtgagatttttgtgcacccatcacctaagcagtatacactgaacccaatttgtagtcgtttatctctcgcccccctcccaccctttcccccgagtccccaaagtcctttgtatcattcttatgcctttgcatcctcataacttagctcccacttatgagtgagaacatacgatgttgagtttcccattcctaagctacttcacttagaataatagtctctagttccatccaggttgctgtaaatgccattaattcattccttttcatggctgagtggtattccatcatatatataaatatatgtatatatgatgtgatatatatgtacacacatataatatatatatatacatatatatcatatctatacacacacacacacacacacacacacacacacaacaatttctttatccactcgttgattgatgggcatttgggctggttccatatttttgcaattgcaaattgtgctgctgtaaacatgcgtgtacaagtatctttttcacataatgacttcttttcctctgggtagatatccagtagtgggattgaaaactgaatgaaatggtagttctactcttagttctttaagaaatctccacactgttttccgtagtagttgtactagtttacattcccactagcagtgtagaagtgttccctgttcagctgggcatggtggctcatgcctgtaatcccagcactttgggagcccgaggcaggtggatcacctgaggtcaggagttcgagaccagcctggccaacgtggtgaaaccctgtctgtactaaaaatacaaaaagtagctgagtgtggtggtgggcatctgtaatcccagctactctggaggctgaggcaggagaattgcttgaacccgggtgacagaggttgcagtaagccaaaatcatgccattgaactccagcctgggtgacaagagtgaaactccatctcaaaaaaaaaaaaaagtgttccctgttcactacatccacaccaacatctagacttaattttttggaactattttgggttcacaggaaattgagcagaaagcacagagagttcccatgtatctcctgtccccacctatgcacagcctctcccactattaacagggtggctcactgattataatcatgaacttacactgacacatcattttcacccaaagtccatagtttacattggggtaaactcttggtgttatatatcttgcgagcattggcaaatgtataatggcatgtattcaccattatagcaacatacagaatagtttcagtcccctaaaaatcctctgtgctccacctgttcacacctctctccccctaacccctggcaccttgcaattgtcttttaagtattttaatcacatccactctcaaatccattcttcacattgcaaactactcttttcaaaattgagtctgattttatcacttctctgcttaaatctctttaatagattcctattgttctttcctttgtgtggtgatttcaaataatagattcaatttctttaatagatactggactattcaaactttctgtttcttcttgtgccagttttggtaagttatggctttaaaggaagttgttcatttcatatatgttatcaaacttattggcacaaagttgtatatgatatgctcaagctgtcttttagatatccttaggatctgtaatgatgttctctgtttcattcctgatactgataatttatgtttttttcttaatcagcattgctagaggattattaattctattcatcttttccaaatatcaactttgaactttgttgattgttctctattgtatgcctgctttgtgtcccattgatctatattcttatttttccttccttctacttactttgtatttaatttgttgctcttttactagttttctgagtgggaagctgtgatggttgactttaacctttcttattttctaatttagtcacctacggctagaaaatctcctctaagcactgcttcagctaccacccagaaatttttcttttttttttttaataaaaaccactttttgtaatcccagcactttgggagactgaggcaggatgatagcttgagcccaggggttggagaccagcctgggcaacataaagagaccccatcgctaccaaaccaaaaaaaaaaaaaggaaaagaagaaacatatgcaaaataaacaaaatagtataacatttatgtgtccaaaactcaccttcaacaatcatcactatcctgtattttttcatctataccttcacccatttctcacatccctaatttggtggtggttattattaattttcaattctgtatttttaggtacagttacacacgttgaaatgcccatatcatttctctataattttgataaaaggacccctacaatctagacttctatcatgatataaaatagggattagcaaactatggcccatagcctgtttttacagactggaagcaaagaatattttctacattttaaaaagggttatgacaaaagaaaacaacaacagaaaccatgtattatctgcaaagtccaagttatttattatctgtagtttatagaaaaagattgctgaccctgatataaaacattcccttctctccaaaatttcacttgtgtcccttagaaaatttgtgttcaccgaaaaccagaggcaaccacagttctgtttttctgtttgtttgtttaacttgcattaattttgctccttctaaaacatcatataagtggaaacagacaacagaaagactgtgatattcatccatgtataagtagcttgttcctttttattgctaagtagtattccattgcataaatatagcacaatttaattatccattttcctgctgatggacatttgggttgattgcaattttggctattgtcaatataagtgcaatggatattcttgaaccagtctttttatggacacatatttgaatttctcttgagaatttctcctagaaataccagggagggaatttctcggttaaagaatagtatacacttaactctataacacactgtgaaatattttctcattttactttcctgcacacaagttatgagaattccctttggtctacatcattgccaatatttgatgttgtcagttaatttaattttagtcattctagtgacttgatgaggttatctcatagtgttttttatttttaattctgctaaaaagacataaaatttaccaccttaaagtgtacagttaagtagtgttaagtatattcacattgttgtacaacatatctctggaactttttcaccttgaaaaactgaatttctgtacccattaaacaactctccatttccttcttcttgaagttcctggtaaacaccattctattttctttttctatgaattttcactacttcgtatatcctatataagtagaatcatacagtatttgtcattttgtgactcactcatttaacttagcataatgtttcattgtgtttataaaatatgttttctattcaggtataatcaacataaaataaaatgtacacatgctagatgttctgttcagtgaattttgacaattgcatgtatctatgtaaccattctccaaaaaagttactaatatgttcattacaccggaaagttcatttgtcctccttttcagtaatttatcctatcccataggcaatcactattctgatatctattaaaataaattagtatttttttctgttctttgattttatgtaaatggaatgatacagtgtcttgtgcctgtcttctttctgtcagcacaatgctttttaagattaacatatgattttgcatatacctgtaggtcactttttaaattgcctagttgtatttcattttatgactatatcacaatttatcattctcctgttgaacatttggcttgattctaattttttagaagagttttttttgacaattttatgaataaggcaactataaacatttttcattatggtaaaaaaaatcacataacataaaatttaccatcttaaccatttttaagtatacagttcagtagtgttaagcatattcacattgttgtgaaacatatctccagaactttttcatcttgcaaatcttaagctttttcatcttgcaaatctgatcttgaaaatctccccttttctatttccaacagcccctggtaactaccactctttctgttcctatgaatttgactactttagatatctcatgtaagtgtaatcatatagtatttgtgtttttgtgactgtcttatttcacttggcataatgtcctcaaggttcattcatgttgtagcatgtgacaggatttccttcctttttaaggctgagtaatagtccattgtatgttattcatttgttcattgttaaatgtttgggttacatccacctcttggctaacgtgaatagtgctgctaggaacatgggtgtagaaataccgctttgagactgtgctatcacttcttttgtacatatatctggaagtaagattgctggctaataagatggctctatttttaatatttttataaagtttcatactgttttccatagcagttgcaccattttacaatcccaccaacagtgcacaagtgttccaatttctccacatgtttgccaacacttattttctgtagccatcataatggggttaaggtgatatctcctagaggttttgattttcatttctctattaattggtggtgttggccatcttttcatagaaagctataaagatttttatatatgtcttttgtgaacatatattttcacttctcttgagtagatacataagaataaaactgggtcatagagtagttgtatgtgtaactttatgtgaaacatccaaactgttctccaaatcagttttgacattttacatttccatcggaaatattccagttgctctaaattcttaacatttgtctttttgatatttgcctttctagtgtgtgtgaaatggtatcttatactttaatttgcattttcttgatgactaaagtttttgagcacccttttaatgtgtttacaattcacttgtatatcttcttgtgtgaagagcctgttcaagtttttgcccagtcttaaacattgggacttttttgtatttttgtttttaaattacagacattctttatatatcctgaatagcctttgctgaactatttattttgtaattatttttctcaatctgtggcttgtctatgatgtcttctgttgagcaacatttttagtttcaaggaagtccaattgtccaatttatcattttattttcccctccaactcccctccctttccctctccttctccctttttcctccccctttgtccctcctactttctttctctttgtctttctctctctctctctttctttttctttctttctttctctttctctcttcttttctttcttctttctttctctttttctctctctctctctttccccctccctccatccctccccctctctctttctttttcttcttcttctttttttttttttggtggcctaagaaatccttgtctagtccaagattctgggtttaggcctatgatccattttgaattactttttgtgtagagactgagacaatgatcaaggttcattttttgcatatagatacccagggttccagtaacaattgtttttaaaaagctttccattgaattaatgttgtaacttggtgaaaaattaactgaccatatatgtgtgcatatatttttggagtctctgttctgtttccttcactcattagtgtaaccataatgccaatatcacactccgttggttatcataactatagagtacctcctaaagtcaagtggtgtaagcctctaactttttttttcaagattgttttggacattgtaaattctttaaatttaaaataaattttgaaatcagcctgtctattacttccacaaggttttctgtaatttttgatggggattgcaatgaatttatagagacatttaggtaaaatggacatcttaataatactgagtctttcagtccattaatgtggtatatgtcaccatttatttaagttttctttattttttcttatcaaagttttgatactattatacatgttgagtagaaatggtaagagcagacatctttgccttgttcctggccttagaggaaaaggaatcaatgttttatttttaggtttgatgttacctgaaagtttttcacatttctgagtttctatgattcttttaatcataaagaggttttatatttatattgctacctattgcaattattcagtggttttgctcttttattctgttaacatggtgaattacatagtttttgaaagaaatattaagcacatcctaatatccccgggatgaattccacttggtcacgatatattatcattttaatatattgctagacgatatttgctaatcttttaaaagaattttgcatctatgtttttaagaagaattagtctatacttttaatgtttgtcagggttatgtttggcttcataaaacaagtttggaagtctttgcctttttctgagagtttctgtaagactggtattatttattaaaatttttaataaatttcatcaataaaatcatttggtccttggattttctttgtggggatgtttttgaaaacaaattcaatttctttgctaaatatagggctcttaggattattatttcatattgtgccaagtttaatcagttgtgtttttcaagaaatgtcaaattcgttattgactttattagcataaagttgtttaaaaattcctttatcatcttactgatatccgtatgatctgtagtgataccatatctttcattctagatattaataattttttctttttctttttgtcttgatcagtcttcttagagatttattaaatttattactttgttttaaagaacaatgttttgattttgttaattttctccacattttggctattttctatttttatctgctcttattgttattatttccttctttctgcttatttttggtttattcattcttattttttgaacattctttctttttaatttaagcgacatatttacatttaagctctgctgtagctgcatcctgcaaaattttatgttatattttcattgacctttcagcttgaagtaattatgatttcattattcttttttgacccatgtattattttgaaatatatgcttaattaccagatatttgtggcccttctagatatcataattaatagatttctcatttaattctgttgtggtcaaagaatattatctgcaaatttaatcttgaaatttatcaaaaactttggccatagccaagcatgtggtctgtgttactgaacattccacatacatttgaaattaatgcatattgtacagttgtttggtatagagtcctatcaatatcaattaggtcaagatggttgatagtgtgattcagatcttctatatccttactgcatttttgtcaatatgctttatcaattaccgtaaaattttcctattttctaattctgtgagtgttttcttcaggtgcattgaagttctgttattaagtacgtacatattggtgtgctagtaaatgtttaacaacaggctttctgaaaaagatccctaatttggagcattttctgatttctgtgctgtgagtacctccattgtaactaatctggggctacccatgtgatgtcactgaacacagagatggtaagaaatatgcaaaatattcttcttatgatccagcacatcaaatattcttcttatgatccagcacatctttgcacatatacattttattattatgtcttattttatcattatgaaatgtccctctttatgtctgataatacttttttcttgatttctattttgtccaataataacatagccaatttagctaattagttttttgcatgatttactttttctgtactttttctttccatgcatttgtgtctttggattaatgttcatcttatttagggagcaggcatttgtgtcttgctttttatctccccattctgcaatctgtcttctaattgaaatgtttaggctacttacatttaaggcacttattgatacagttagatttctcatcatctattttgctatatgttctctatttgactcatctatgtctctgtttgttcctttgtttcccttttcttgctttcctttgggataaaagtgtttttcatatattccgttttgtttcctatattggcattttagcgatacatttttgcacgttttagtgactgtcctaggaattgcttaaatgcatcttgaatttatcatagtcttcttagaattaatattccacttctttacttaaaacataggaaatttgtaacagcagtgtcccatttactagcctactattctttgccctattgttatcatatgtatacctacatttattgtgaaccatataatatagtgttaaaatttgttttaaacattcatatgcatttcatacaaattaagagaatgaaataaaaatatattctgttatatttatcaacatatttactatttctgataactttaattatctcctaatagagccaagttaccatttagcatcttttctcttcaacctgaagatcctccccttaggcattacttgtattgcaggcctgctgatgatgaattttctcagttttcgtctatttgataatgtctttgattttgaatgatatttttgcttggtacagaattatgagttatctgtgtttattttcttttggcatattaaagatttcgtttcattggtttttttttttttttgcatttctttgtttctgatgagaagtcagccattattcatttctttgtatgtagtgtgtactgtttttctctgactaccttcaaaagtttattttcatatttcagggttttgactgttaaatgtctaggtattgctttctttgtatttaatctccttggtgggtcactgaacttctgagatctttaagttcatctttggattgtaggagtttgaatatgatatatgcagggcattttctttgtgtttattctgtttgaagttcaatgagctccttagaattttaagttgatgtcttttactaaattcacaaaggttttgaccactatttctaaaaaaaattgttttgctgcattttctttatatccttctagaactcaagttacctatgtgttagtctgtttgatattgtccccacttatcctttttccctctgtttttcagactgggtattttttattgatctctcctcaagttcattactcttatgtcatttcctaagcccacctagcaaatttttttacttcagttattatattttccagctatatactttccaattggttcatatttatagtttctttttctctgccatgttctatacccatatattcattttgcatatattttcctttaaatcttcaaatatatttataaaatctgtgttaaaggccttttctgctaattgcaagatttgtgtcattttgggatgaatttctattgacctttttttttcctggagtatgggtcacatttttttctatttctttgtacatctaaggctttttggttcattactgaatattatcaataatacattttagaaactctggatcctgtggtgttgctctaaagaactatttttttgttcttgtaggtaaacccaaattttactcattttagttgtctttcaaatatagttctacctccatttctgctttcggtcactcttcactgtcttcaaatggtttttagaatatttgattcatattttataggtttctttgtctactgagtatttaaagacagtgttcaattgtcttctgactttgttatgcattcccaagtatctaatgttttttattttatgctagatattttatgtaaataaatggtagaagctccaggtcataatttctaccagcaaggacttttctcttttcatttgttaggtggattgggtaaggaactaatcacattaatcgaatcaaagattgagcaggattgaagctgtgttgcagttttagttagactcagtccaccactaattctactgtttctcaggcatatccttccaaaagtctacaagtctctctcctccactttgaaagattgggatattcagactgtacttcataacctttttcctctactctcaatccatgctgcttccaaatttggcaaatttcttgaggaagacaccaaccgaatgtttgttgcaggccctatttcttcagtgagactttgtcttctaaatatttggaaactacagaagatctcaaacaattttacagaagctttctagtctcctctatagcccccagactcagaaaatatgctgtggggagaaaactagctcacatttaggcctcctgaaatttattaattgtgataccagtcttctacaattgccaaaagcattaccagtttttgcattttcccagcaaattctttctgttaggctaagcccaatctttggcttgtgctggaaatcagcagatgtcctcagggaagaaaatggctgacaacagcctggttatcttagaagggctcttgcatctttgagttttagattctttttttgcacctacatgtccccagtggttttttttttaatatattttttcaatttttctagctgttaaaagctgtagcatcaggaatggtggtctgccataacctactacaccctacttggtattcaatgtccctataatcatttttaatataaataaatagctacttaaaatgacctattagattctgtataatctggctcttccctgtctcttcagtcttatatcaccatcatatttccctcaaccgctctgcttaaggcacactggcttttacttagtgtttgggttgtgatatgctcccagcgcaaagcctttacctgttctattacaacccctaaaatacttttccttcccttctttgcatggtttaatccactcatcttttaactcccagatcaattcttacttcccatgaagcctgtcccaacttctctgattggtcaaagccccaattatacatactcacattatgtaactctcctccataggacttgtcagagtcgcaaattttgtatcattgtgtaatcatctggttaaaacaagaggtcagaaaccatgtaacattttgttcatcatttgtccccggtctgtctctcagggactggcaaataataggtactaaaaagttttttaaatgaataaaatattgctagtgggaaatataggatcagaagtctttcactagtacctggttaatgtgttctatatgaccattgacttctgggtgttagatagtgggtaggttgatacggggataggaggtcttgaacaatagctctttacaacaaaataaaaataaaaagaaatgcaggaaacagacatgaatcaccaattaactcatggaggtacaacattttcttgtcgaggccaggcacagtgtctcgtgcctgtaatcccagcactttgggaggccgaggtgggcggctcacctgaggtcaggagttcaagaccagcctggccaacatggtgaaaccctgtctctactaaaaatacaaaaattagttgggcatggtggcacgcatcagtaatcccagctatttgggaggagaaatagctatttgggaggagattcgcacgagaatcacttgaactgggaggtggttgtggcagtgagctgagattgcgccactgcactccagcctaggcgacagagcgagagcgagactctgcctcaaaaaaaaaaaagaagaaagaaaattttcttgtcaaaatagacagcaattgctgatatagctgcgggtgagcacttatgtggagaatgacattttcataaaggtatacatacccacctctaggatgggatttcagctgctgtggaagagggacacgtagagattaattctggtgttatgacatcctaggaacttttttcaagtgggtgaaggagtccttcagataacttaggtcagtatttgacttaggaacagatgtctctggtggctgtatgcttaaaggtgtcgtgttacactttgggagtctaaggcgagtggatcacttgagtttaggagttcgagaccagcctggccaacatggtgaaaccctgtctctaccaaaaatatgaaaaattagctgagtgtagtggcatgcacctgtaatcccagctactcaggaggctgaggcaggagaatcgcttgaacctgggaggcggaggttgcagtgagccgagattgcgccactgcactccaacctaggtgacagagtcagactccatctcagaaaaaaaaaaaggtgtcttgtcaaatatgaagctaacaaaatccttgagagacaggacacattcaactcttaaacatttgatggtagccagccagataggtattatggaagaggtaaagtatatgtctaccctgtaaatgctcatcttgctaaagctgatgttgcaaactttctctgcatcctggggttgtccagaatcttggtaggacatgactgcatgtaggcatctacctgctctttatatgggatcttctctgttggttacagctgaggatggatgcctataaagatctatcaaagatctagacagaattattcccatgctagtaccattagtgtaatgctagatgttttaacaaatagaccttcaaatatgtaatgtctcaaacacagcagaagtttaattttcacccaaataacagcacaaggtgggtattcctgtactgttggcaggtgactctcttccaatatcatgactcagggacccaggctataaccatctcatggctctgctatgtcttagggccgtgtcatcatctgcattcacccatagaagtgggaaaataatatggaagagggtataaaagccttagcctagaaatggcacgtctcacttcctctcccattttattgcctagaggaaggggcatatatcggttcctcttctattccattgcttggaattcagtcatatggctacacttaggtccaagaaagactggaaaatatggattagctctctgcccaagaagaagagaaaatacatttgtgttgaacagctagtagcattgaatatgacaactttttactttttcttccaacagagttccagagcccagtagttttggctgcttgcttcataagaaaatagaactttaggagcaatgcctattttgctgtttgtgggctgagtttctgtccaccttaactggtttaggttgcagtggatgaagagaattgtcatgggtgccaggcccttatgcttagaaggcaaccttggtggtcaatagctgacattcccaccagggataatttaacctttgcttggatcatattctaagaagcaagctcatattctaagtcctatagtgtaattcatctcaataaatggcccaccatccgttccgtgttcaaaatagaataattctttatttcattctttcctcccctccccacacaagaagtcacgtgatttatagctccaaaatacatctcagatctgccttttgctgttcatgtacactgttaccattctaagcctatctctctatctatttagatagatatagatatacatatctgtgtaaacatgttgtaagtttctataattaataaattttaatggtgaaattcaccagacacttttcttcatcttacctgacctctctggtatttatcacactttcctgaaattctttctggcaggcatttttctcactttcctgaaactaatcctgtggttttaacaatatggttttaaataggcttttctctacttcctggcctttcttctaagtcttattattgcaggctgttcttccttttcccgctcttcaaatgttgatgtttcctttttctctttttctttatactttccttgggtaatctcatttgttcccactgattttacctaaaatttaattgcttacaattcccacatgtatttatactggtcagaactcattccttagtttcaaaccctgaatatacaactgtctttaaaatagttcccccttgatgttctgtaggtacctcattctcaatacgtctccaactgaatttatcagcctttccacccccaaatgtgcttttccatctgtcttaggtcagattccccaaaatctgagcctgagatggaaattcttgttcaaattatttatggagaaaatgctttcaggtaaagagtgagggaattaggataggacagggtaaaagttaagcaagtatttgatttcagctggaaactagcaacagtatgatcttatggggaaatgctggagcacaagttataccatgaatcttaccttgaggctaggaagctggacttttgtactgtcctcagtgagtaaattactgcctgaggcctgtgggtgggacctaacctctcaggtaaggtggctcaccattaatttgggctctaggacagtttttttttttttttttttgaaaatggagtaactatgagttatcagtcaacattcacagcagttgggggatgcatggttaaaggcatatgggtggggcaccagcatatccactattacctcatccctgaattccctatattaatatgtagcaccactgtctacccaggtatccaagtagaaatctgggagtgatcatggagtcttttttcctctctctcatccctcatttaagtagtaataataataaatgataattattgagtgcccacaatataaatttcaaattccatagcatggttcataaagtctcatgggatatggctcctgtccatttctccagtctggtatttaatattctcttccttacactccactgtggccaccctaaacctgttgtggttttctccacataatgtgctatcactctcaacccctctcatcatgtcatcatcacctgatcaactcttaattgtcctttgagagagtccacatattacctccttagggaagccttctctgactaccctagggtgaattagatacttaacatttgagctcttacagcatcccatgcccccatttttcagaacacatttcacaacaaaatacaattgttggattacttgcttatcacccttcattgaatgtgagctttttcgggacagtgattttatcttgtttgtctctttttctctagcatgcattccagtgtcttggatgttgtgaacatgcactaaatgcttctcacattagtgaaataaaatgaatgaatgcaaagagaaagtgtggccaaaattctaaatgtttcttctgaaaaaaattgtataagctctggcctgatgtttatatagggaagctattttaatagatgctaggtagatgagtattcatagaaagacaacctattctacattttacggtatcatctctctttagtcctcttgagccactgagctccattccagaaagtcccaaaggaatcagagagaaatctgcagcttgagtttcacttataattatgctaaaagagatccctctctgaaattttcccctttggccattgaatttgttttctactgctgctgtaacaaattagtgcaaacttagtggcgtaaaacatcactaatttattatcccacagttctgtagatcagcagtcaatgccgactcagctgggtgttttgcttggcatctcaaaactctgaagtcaaggtgtcagttgcactgtgctcttatctggagacctgtggcagggggcagggctggggtgagggggaaccatttctaggtttcttcaggttgcctgcagaattcagttcagtggggtcataggatcaatgtattagtccgttatcatgctgctaataaagacatacctgagactgggtaatttataaaggaaagaagtttaatgaactcacagttccacatggctggagagggctcacaatcataggggagggtgaaggggaagcaagacatgttttacgtggtggcaggcaagaggacatgtgcaggggaactcccctttataaaaccatcagatctcgtgaaacttattcactatcatgagaacagcatgggaaagacctgcccccatgattcaattacctcctagtgggtccctctcacaatatgtgggaatcatgggaattcaagatgagatttgggtggggacacagcaaaactatattaattgaggtccccgctttcttgctgggtgtcagctgagggtggttaccagcttctagaggctgcccacattctttggcttatagcctccttcccccatcttcaaagccaacaatggtctgttgagtcctcatattttgaatctctctgatttatcttctgcactcttcttttgtttttatgggatcacgtgattagttagattaggctcaccctgataatctcctttttgttgtataacaaaacacaatcacaggagtaacactaggggttggagatcatcatgggagtcaaaattctgtcaaccacacaaccaatcataagaagggtcaagagaaggttatgtgccctcaactgtggtccccagttgagacaggacagctgtgactctcatttctgtctctcatttccagatgaaggacttgcgtcatgagaatattaaccctttattgggtttcttctatgattcggggatgtttgccattgtgacagaattctgttcccgagggagcctagaagacatactgacaaatcaagatgtgaaacttgactggatgtttaaatcatcactcttgctggatctcataaaggttaatgggaagactgaggaaatcttggattttctctgtagattagaactttaatgttttgggatattttattttcctcagattgttgtgatcatttcactccttactttctgtattagtccattttcatgctgctgataaagacatacctgagactgggaagaaagagatgtttaattggacttacagttccacatggctggggaggcttcagaatcatggcaggaggtgaaaggcacttcttatatggtggtggcaagagaaaatgaggaagaagcaaaagtggaaacccctgccaaacccatcagatctgatgagacttattcactatcacgagaatagcacagaaaagaccagccctcacgattcaattacctcccccgggtccctcccactacacgtgggaattctgggagatacaatttgagttgagatttgggtggggacacagccaaaccacatcattccacccctggcccctccaagtctcatgtcctcacatttcaaaaccaatcatgccttcccaatagtcccacaaagtcttaactcatttcagcattaacccaaaagtccacagtccaaagtctcatctgagacaaggcaaatcccttctgcctatgagcctgcaaaatcaaaagcaagctagttgcttcctagttacaatgggggtaaaggtattgggtaaatacagctgttctaaatgggaaaaattggccaataccaaggggttacagggcccatgcaagtccgaaatccagtggggcagtcaaattttaaagctccaaaatgatctcctttgactccaggtctcacatccaggtcacgctgatgcaagaagtgggttcacatggtcttgggcagctctgcccctgtgactttgcagggtacagcctcccttctggctgctttcatgggctggcattgagtgtgtgtggcttttccaggtgcacagtgcaagctgtcggtggatctggagaatggtggccctcttctcacagctccactaggcagtgccccagtagggattctgtgtgggggctctgaccccacatttcccttcctcagtgccctagcagaggttctccatgagggtcctgctcctgcagcaaacttttgcctgggcatccaggcattcccatacatcttctgaaatctaggcagaggttcccaaacctcagttcctgacttctgtgcacctgcaggctcaacaccacatggaagctgccaaggcttggggcttccgccctctgaagccacagcccaagctttatgttggcccctttcagccacagttggagcagctgggacacagggaaccaagtccctaggctgcacacagcatggggaccctgggcccagcccatgaaaccacgttttcctcctgggcctccaggcctgtgatgggaggggctgccatgaaggtctctgatgtggcctggggacatgttccccatggtcttgtggattaacattaggctccttgctactcatgcagacttctgcagccagcttgaatttctcctaaaaaaataggttttgcttttctactgcattgtcaggctgcaaattttctaaactgttatgctctgtttcccttttaaaacagaatgcttttaacagcacccaagtcaccttttgaatgctttgctgcttagaaatgtcttctgccagataccctaaatcatctctctcaagttcaaagttccacaaatctctagggcaggggcaaaatgccaccagtgtctttgctaaaacataacaagagtcacctttgctccagttcccagcaagttactcatctccatctgagacacctcagcctggaccttattgttcatctcactatgagcatttttgtcaaagccattcaacaagtctctaggagagtccaaactttcccacattttcctgtcttcttctgagacctccaaactgttccaacctctggctgttacctagttccaaaatcacttccacattttcgagtatcttttcagcaatgccccactcgtagtaccaacatactacattagtccattttcatgctgctgataaagacatacccaagactgggaataaaaaagaggtttaattggacttatagtttcacatggctgtggaggcctcagattcatgatgggaggcaaaaggcacttcttacatggtagcgggaagagaagatgaggaagcagcaaaagtggaaatctttgatgaactcatcagatctcgtgagacttattcactatcatgagaatagcatggaaaagaccagcccccatgattcaattacatccccctgggtccctcccacaacacatggggattctggaagataccattcaagttgagatgtgggtgggatcccagccaaaccatatcactttccttcccaagtttttaccccaccacccttctcacagtccttttgtccatatctgttatatgatacagatatggaaaaggtttgcctgtcctctccccagtttgaggtccagatttttctttacttcctgttgccattaagcactcttctgccttaagcgatcctttctttcatccaatttctctgctttgtggatgtgggaaagtgctcattcccagattatttggtgctacttagccctacctcctagttttcacccttctaaatggtggctcagtctagaactaggtgagaggtctttacatacaatggctgtgtatgtggaactcagtgccactggaaaaccaaaagaccagtggatctatcaggcatcacctttattctctgagccaaagattcctgacagccaaggtagggttcatagatgagtcccatggaggagcttctggggatcccatgaacgccatggaatgatatgcaaattgtgtatatgtgcattttttacagggctgatctgcatactcaatgactttttgggcttcctgcatactgatcatagtcttgacctttttctgctagcctaatcctttttcaggggccttgaaagggaaagacattctctcatgccaattccctttaagataggtgtgattagcctccttttacagaggctcagggaggttaaatgaggtactcgttgttatagagtgtctggcacatatagtaggtactcaataaatatttctcagccaactattaggtggcggagctgataataaaatccaaatctcctgattcttattctagtactttttctgctcacactgtaagctaagcccagtgagttaagggaggagcctctatatgacaatcccctcaaggccatgatgaatgaaaagcaaccgttagacaacatggggggaatcttgcccactgtagactctactcagaagtactgaagagtgcagactatccaagagcacagggtgaaaagaattccaagtacaaaggggtgtcacactgcaaaagagccagatacttaaaaagacttttagcaaacaaagttctgaaatgactgtactagaatataaatgtatgtatatacagaatgaataaatccatctgaacgagagtcctggtcacatttgaataccatatgaaggctgccaagcaagtgcagagatcggcactagacagctttcttctttctggttgcctatttttaattacaaaaataatatattaagtgtaaaacgcaaatgacatatattggaaaaatactcgcatttactcaaccctctttcttcatactccccctcaaagttaactactgctaacaatttggcaacccaccttgtaattaatttcttgtgtatttatatgcattacagatgacttttttgtttgttaaatatacatgctgtcacatagttctgtaattactatatttcacttactttatggattagagttgtttctatgtcagctacatacagatctatcttattctttttaagtgctgcagaatattccctagtgtgaatgtaccacactctagccagtcccttattgatatttagtgcatttccaattatatactattataaaagcaaagctacaacaagcattcttatctttgtctctttgtgtatacatgcaagcatttctctggaggagaggtagaacccctggatcatagggtacacatagtttaaattttgatagctattgccaaattgcccatgcacaagtttgtcccagtttccattcttgccaataatgggtgagagtgggttagaacttttggggaaaatcaaaatctccaaattcctggtaattatatgtatatggatccattctgtatctgaaatgttaataaatctagtaacacataattctctgcacacacaagataacattctttatcaaagcataaaattttagagctacgagggatctgaaaactgactcaggttgtcaaaggtttactttgcctgcatagaagagaaaaaagctgagttctggatcataatagctcatgccattaacaatctcagaaattggtgttaaaagcacaaaatagttaaatgagttgctaaataaatcctgttgtgtcatctacagggcatgaagtacttacaccacagagagtttgttcatgggaggctaaagtctcgaaactgtgtggtagatgggcgttttgtactaaaagtgacagattatggctttaacgacatcttagaaatgctgagactctctgaagaggaatcttctatggaaggtaagcaatgaattgtacccttctgatgcacacgaggtaactccaaagttcaaatgaaaatatgcactgaattaaagcctcaggctgatttcaactctccacttttgttgaaaatccagcctcatttccaagccaagggacttgaatgaagtaggcctgctgtaacctcggcccagccaagctttctgaacaaagccagtgtaataatgttcagttcctgctgtggcaggattaggatgtattgtttggagaccccagcagtccctggaaaaacttgctgagcactaggcacacagtaggtgctcaataaatacttgtcaagttgaatggagagtaatttggaagctggacccccacaacgtacattttagaatgggacgtcactagagcataccagcacagtctctgtcagagaggaagaagcgaggagtgatctctcagcaaataaatgctctgtggtttatgtgggaaggcttcaggcagaactgtggccttctagcaaataagtagccatgcctgtgtcaaagtcaaataaaaatatagggacaaatctttaaatgaaacattttatttgggaaaacagaatttcattttgtggcatgcacatagaccagggtggtccttggtgtgtccaaagaacacagaaaagttgggggttttattggaaagagaaatgttatatatggtttttaaagaaaactcattggcactaccaaagttttggggagcaggaaagctccgattggtaagtgatggctgtaggtaaaactcgtcttagagtcatgacagtttctttcatcagctactaggtaaaactgatattaagattatagaaggtcatttcggtatctggcttgcaagattatccctgggcaggcacttgtgccccaagtgcttttctttttctcccatggtctctggactccaatttaattggatataataagataactccagttcatatcatcaattttcacaccaacaacgtccattttgtgtttttgtcttctgtctagtgcaccagtggtagcactaaacaatgccagtaggagttataacagatcaaagaaataggagaaatctgagatgggggtgggtgggtgagaaccagggaagaaggagcagatagatgagggggagaaagaggaaaaagaaagagaacaaatatgatgaaatacgtataggaaatgtgggcattaaatgttttaaccaatattgcaagcataaagaagagagatagtgacacaaaagacagaaaagcaaacagcccaaaaaaagatagacagagacagagagatgcaaaactacatcatatatccatattcttaaaattacctttggcgtaagttttaaaactgctgactttactacataaaagaaaagaagaatgaaagacacacagagagagagagacacatgcatagacagagagtccagtcattggtggtatctggactttataagactttgctctttataagacttgtgggttattaaatttagggagtcatctagtccaattccctccttttacagatgagacaactgaagctcatgatttgctccaaacctgcagtgacttagcagcagttctaggacttcaaattcaggttttctgaattctagcccctatcctgtagagagggcaagtacttagtattttgtcaaaatcaattctctataaaacacaataccttgggaggctgaggtgggcagatcacgaggtcaggagttcgagaccaacctggccagcatggtgaaaccccatctctactaaaaatacaaaaattagctgggcgtggtggcgcgcttctataatcccagctactcaggaggctaaggcaggagaatcgcttgagtctgggaggcggaggttgcagtgagccgagactgcgccactgcactccagcctgggtgacagaacgagactctgtctcaaaaaaaaaaaaaacaaaacgcctagcttctcagagttccatttaatttccagatgggcaactttgaaacttaagaaaatctagtcttagggtgggtaaaggatagctgcagggctctcttttctggttttgtgcttttgggtggactatgtctgtctgtctcctctgtctctgtctctgtctctccctcttatcatattactccattctccaaattgcagtggcagtatggatggtcagtccattcttcacacactgcagccagaaggagctttctaaactgcaaatctgatcatgttacagctgtgcctaaatctatcgaatggcttcccattgctctaaggataaagatcaaattcctttacatggcttacgagctgagccctgcatggcctggaacttgctgacctctcatgctaaccactacccccctgctttatgctctggccatgctgaactgcttctagttgtttatttacattacaccaggctgtctcttactactaaatctccacacaagctgtgtcttctgcctgggacactcttctcttcccactctttcatatactcatctgggtctggctaaattctatttcttcagggttcaacttaagtaccactgcctcaagaggctttccatgacccctatgctgggctaggttgccctctttataatccttcagggccctgaactttgttgtgataccatagttcattagcattactcattcaattaaccttgtctccccccacccaaactacaagctctgtgggggcaggaaacaggtttgcctttctcagtgcctttcacagttcctgacagaatatttgttgaatcaacaaaagaacaaaataaaatgaaataaaggaacttgtctccctaccttagatatgaggctaaatgaatctcataattgaaaggccattggatgtcatctgacccaacttccattttatagatagggaagccaaggttcagaaaggtagctacttggtgaccaagctaagattttgaacccgggtctctagacttccagttctgtgttcttttatactataccacagtagctctccaaagtcaattctatcaccctagcaaagctcagagttaatagtggctccagcagataaaaaacaaaccaaagtaatttctctagttttcccgagagttcaactctaatggtagttagtggctcttacttggttctggagtggagatgaggaaatgggggcggattgtaaatgtattcattactgtccactctcgattatataagtatagtgcagaaaagcctcattatagccattaacaacatacatgtaagtgctctttggaaatactattttgtaatgattgtatttaatcacccagcttttaccagagagttttgccctctttttccatcttgtgcttttaaatgtgcagggagaaaggatgccaaaaagaagcagccacatgccatttttcctgctctcaaatattcatccttgcactcctctccaaaaccatggtgcctaaaatcccgcaactataaatgtattcctttgacattcaatcattcaagtatcattcattgttttccgtttgatttgtaaatataaatcttcctaggcagggagacataggggcaaaatcactatagtgagtgttttggagactttcatgggtgtgagtgagtggtggatggtgggtggaagctcagaggggtctggttgggggacaaagcctggggacacttaaagagcaaagagagaagatgggtacatgattggtggtgaaactggaatttcttatttcaccattttgatcaggattggctgaaaataagaatttccatggtggatttctctttcctgggttttgctaacaaaccaaaataatctctcacctttcacccttcttcctatttcataggactttgtttcttggactctcttcccaatacccaaaatttaacaagatgaaaagttagccattactttctccctgataccctcactcttagcagacatttgtctccaacctcactatctggatgtcaccttgttgtttactccaactccctctcattctcaaggcacagggagcctatccttagccctgtcacttccttctccattgtagccttccagtgtatctggttgactgtgttgctgctactacccccacccccatttaggcccctctcacctcactacctgctcttactgcaataacttcctagctgatctccctgattccagcctctctccttcaatccagcttgtgcaggttgccagattaatcttcccaaacagggctttcatcaaatccctctccagctccagcacccctactgccttttgtattcactccaaatgccttcatttggctctcagggcctctcaccttctgcccccattcttccagacacccgccctcccccacttcatcaaccccacttctcatttctcattattccttaacagagcccttctcttcagtcaagctaatctgcttaccaccacccggcatccccccacccgcaatttgctcctttctgcctcttgttcttttgcacatgctgttctttctagggagaaaaaagcccttaccttctcagctccagaaagttgcatccttgaccttcctaacaagcacatttaaaatttaacttttccaggaagtcttcctggattaatttgatcagctcagttttttttttagtttgaacctgatgaaattgccaatatctaactgtttttgattcacagaaatggtaactttatataattcaatctaaaacactcttcttccagcttttgagtactgtatttctattgttaaattatatttctttatacattgcttacagtgccccccacccaagaaaaatttctgacattctcactgccataaactctgaatgcagaaataatgttttgtccctgacggggcctgaaatgcagcagagcacacaatgggtgtttaactttgacctttaatggattcatttccctttactatgtagtggccctcatcattccctctcttttattgcagttaggggtgcatatgtctgtgtttccgactggtctgtgaactcctcaagtttgattcatctctagcaccacctctgtgcctagcacagggcatggtacatagtagaccatcaataaatatttgcagaactgagttgaaggaattgttgcacctttttgcactgcaaggaataggaaggctggggtaactctaatccttttagaggagacctggagaaagcaacttgtgaatctcttagccccagcacaatcaaattaccagacacatatagatctcagcaaacagcaaatccatggcaaccagtgtggtagcacacttgcctttccctggaaacctgccaactgctacttgcaggctcaagaaagcaagcaccagagaatttctatactttgagcttctgtgccctttcccacatcgctgctgtgtctgcctgcgtggtcctggggtggagagagtagtatgttttctctgttcataattccttagaagaatagattcagaccctgggggatggggggcactagcatggcagtctgtctaataaaaatataaggcagtcaataaaacagtaccctctgagcccttgagggcattgcagatattgtcagttaatcctccctgcattcattacacaatgctttctttttagagctgctgtggacggcccctgaactgttgagagctccaagaggcagcaggttaggttcttttgcaggagatgtctatagctttgccatcatcatgcaagaagtgatggtccggggtaccccattctgcatgatggatctgccagctcaaggtaagcgggaggtgagaaaagggccccaggggtccaccatgaccgagatcatcagaccaactcaggctgtcatgattttccagaagagtgttagtgctaacagcctgatagtctgcaagcagctcaagttatgtacaggtgggacttatagccagacagctttaggcatctggaagaaatttcgccacccaagaagctggccttttttcagactgtgatgtaaaacaagggcctacaggactgatgccagtcccttttgtttttctttttaatttcacagtcccctctactcctttgagacactccctgccaagtattttagtatccctcatgatgcttctggatgtcaaggccttaccactgtttccctgtgacatgctccaggcttccatccaaatctcccaccaagacacttggctattaggcaatatccatcaataatgacaaaatcagtagacaaaactttgaggggaaacaggatatctgtatattctcaaagtatgaacccacaagatacttacaaattgcaaatggaaaaaacagagtttacaagtagaggatcctgtagacaccaccttaaacaagcaatcaagattaccaataataagctattaccagtaatacagcacacccatgttatgtacccattgacatgatacactaagaagggcataatgtcacctcggtgttattcttgacaaaaaaaaaaaaatacataacctcaatctaataatgagaaaactttagacaaaccccagctgacattctacaaaataactggctaggactaatccaaagcatctaagtcatgaaagacaggaaaagaatgatgaactatcgcagactgaaagagacaaagacacaacaattacatgcaatatgggatcttgaattggattgtggaacagaaaaaggacattaagggaaaactgatgaaattcaaataagaaccctagtaatattattgtacaaatgttaatttcctttgtactatttttctgtaagttattaacaataggggaagctgagtgaaggtgtacaggcaattgtactatttttacaacttttctggaagtttaattttttttcaaaataaaaacttttaaaaatgaaaaagaaagaaaaactagaaccacttagctaggctttgtcccactcagggttccacattattcctctacttaaagccttccaactgttcctcatcactttttaagtgaaggtgagactcctcccatgacatacaaggccctttacaatctggcccctagctacctctccaggcttatcttctgtcactctctatatcccagctaaaccacatgactggccgggccctgaaagtatcatggtctctcccatctctgtgccttttcacatactaggaggtggaatttttccacctcctcccaatcttgcctcatccaactcatgtcaccttctctgggaaaccttctctgacttctttagtgtgggtcagctgccttttctatactcacaagtgcctatctcagctagagcacttatattgtttgccactgtttattgcaattggactgtgagatccttaagggcatgaatcatgctgtgcctaagcagagaggtggcccattcaacttgatggtgttctgagaaagggacaaagacttcatctgccagagaatggatgaggcagtcaagtttcagggagtacatgctcatggaatctgttgtactgagagcacgatgctgtaatggagaaatcattactggtacagcctgacctgggttaaaggaacagaatgtgtgatgtcacaaggagctgagaagtcagaggcaacaactggaattcttttatggaggcaaggggctcgtattagggataaagcagcactgttggagtgttatagccaattcaggggtgggaaggtcacactggtggggcaagcaaagcttggttcctgatgtggcagttagaattggaggtggtggggaggggattaaagatgagaaatgagcctgaagagatagggacaagagcctggattttactctgtgggtgatggggagtcataaaaggcttttgagcaagaaagtgatacggccagatctgtgttttaggaaaggtttggagaagggtaggctggaagcagagagatcagtttgaggccccagtgtgggttgctggggatattgagagataatgatttttttttttttcctgctgccagggagttttctttttgtaaaaaggtcagtctgactgctctagaccttttgtcactaatggctgttgggtctgaatagggagtctaagaattcccacgtgaagtctgagacatttggaagcaggacagtgtaacaggttgagattgtctgggttcaaatttgaactctgtcacttactagccatgtgacctcgggtaagttacttactctcttcatgtctcagtttccctagctataaaattaaaataagagtgcctacctcacttgtttgtatgtgagaatccagtgaaataatgcatgcaaagcgttcagcacattactggtatatagtaaatattccactggaagtggagttcatggaccgtcaaccaggaggatcttgatgaggccttgaactgtttactgcagttcttaattccctttgcctagacaccaggtagagacctggacctgggctgggcctgggcttgtaagaagagttaagtgggtctattgtggggattggaaggcttagatgattggggatgggtgaggggagccaggtccctgaagttagagcattagaattgccatcagataggcagtatctaaaacctagcagaagcagaataaagtgcctaaatgataccaagagtccaactgattaatttctcactcctcccccattgcctaatgcagcttttgctcaaatatagtctatattcaggccacctaaggagagagcaaaggagatggcccttctgtgttatctcctaacctacccccttcttggctaaaagtcagttatctttgccaaatcttggtcattttttccatgatttgtaaacggttctcttctcgcatctggacagaaatcataaacagacttaagaagcctcctcctgtgtacagaccagtagttcctcctgagcatgcccctccagaatgtctccagctgatgaagcagtgctgggctgaggctgcagaacaacgaccaacttttgatgaaatatttaaccaggtaaggactctgaatcttatcattgcccaggagccttcctgaagtcagcctacacaaggctaactccttgggtccttgtcatattgtggaaggaacctcttgcaaggggtaagggcactcctcttggaggaacagcctgggagtggctactttgaggctcttggtgctggagtgtcatcagcacatccttcaagagcccaaagattggttctagtgttcttctgtgtctgaacctctgttccagaccatccacaatctgacctgatcaacctttcagagatggaattgaaccatcaggcatttgtaaggcaatggcattgaaactattagatgatgggtatcatggaatagatggggctcctcacagagccatgtttactttggggataccagagaactctcatgagtgtaccaattaggtaatttcaggttgtttttggaaggtcaggaaaaatatggagtgtttgaaagggtgttcaagatggaagaaagagaaagtgcaaatgtggcgtgcaaaagcaggagattccttaagtttccaggcaatggggtacatgaaaagtgataaccttcctccttaagatactgaatttctaaagggggtgattctctccctagaggtggggattgaaaggggagtgaaggaaaggacagagtgagccctgctgtggaagctaaggcgcaattccaatgttggagcatgcagtttaggctttgttgaaattacaggacaccaaaactgagggtgctcaccatgagtgctgtgtcagctctggcagagaggcttttgtgcctggctggagtacagcaatgagatgctttatgagtggcaggtatctgaggcggaaagaaagaaagagttggattgaaagcctgaggggccctgcttatgaagtcatccgtgtccccagctaacaatgcctccattagcccggctgagtttcttgaggacactcaaacaggtgttcaatagtatggaagaggcgaaggaccatgaaggtcaaatttctaaaaccttaccatgaggcaggagaaagagcatttgcccctgtgttgatgctagagatgttatttcagaaggcagcagagaagccagtgatagatagggggagtgtacatcatgagactttcaaacaagacattgctatagctgccctcactgaaatgcttcagtggaagtttaggctgtctgatgacaaggctagccacctaacttcctgcagttaataaaacttaagtgggaggaggaggaggagagggaggttccctgggttaggcaatagggggagcccaaagcatctaaactggctacgaggttatcctcaggactttgatggacctgcagatgtgaaccaggctcagaagggaaactcctagtgttggccttggggcattgggtgctaggtggagcatgtgtggcccagctatatataagaggttcactgggacagagccctagatgtctgtttagcaaaaccacctccgattttttgttgttgtgaacacagtcatgtgcatgttgactatagcagtacagaggggctacccctcatgattctaatactatgcctagctccctgttactgtagatagacaaggtcccaaaaaggcgtattgaaaatttgtgacatgcagacatctctaaggcatcagggcatagaatgggggcaaaatcagttgaattttacatcactctgactgaccaaaggacaggtgctagaggacaccactattcttggactccacggtaagaaataggggttgattttatcacgtggatcttgagccctctgtaagaggtcaaggaacctctcattgttcaaaaactggcaacatagtggcatttgaggataagaatgatttagtaaactgatgatccagaagagtaaaatggtactttgggccctctctccccttacctcacacaaaattggcctgggctcaagaccaaatcctgttgtcttagaagtggctactattcacgtgatagcatctcagaactgaaggagccggctcagaacacctttgctcaggcttgaaagaaccagaagggtaggggaagaactggtggggtcgggggtgggggaagaggtgcagtggtagtgccctgtaaatgggtcagggtgacagtgaggatgggtggtgacttttcctatttatatctgggttcacctttcctgccctggcattttggtggaatggatttgtgataaggggacctgctccatcatctctgagtttgatgagtaagcattttctggttcccttttctattttacttccagtttaaaacttttaataaagggaagaagaccaatattattgattctatgcttcggatgttggagcaatattctagcaacttggaagatttgattcgggagcggactgaagagctggaaattgaaaaacagaaaacggaaaagcttctaacacagatgctaccaccgtatgtgagaacacctgaggagtgtgaatccttataacagtgtgttctgttaaaaaaaaaaaagagaaagaaaaaaattacccatcaactaactgctgcctccccttgtcctgcaccttctcttctcctagtgggctttagtcacacctttaaatcaaagtaaaattggaaaccaagggagcagagcacacatcctaattttccactacctgtagatcatgctggtcatttaagtttttgtgcttgttttttctgtgtgtcacttcgtgactttgctaggaggttgaccgattaaaagaaagcagttctttgagctcctagaggaaagtagcaaggtcgtttttccaggtctttcctctcttagctgaaaaccttatctgttgctacagtttccaagttttccagggcaccttacttattatgttgtaacatgatcttctaggagataattaaggaaactagcctcatgaaagggcaatcacctgggagcattccccaggggtctgagttagaagtatagagagatgaaaaccctccacatgaaggcacagaccaggtctgtccagtgctgtattccagcacctggcacagttcctgaccgattgtaagcacttaacacttatttgtagaataaatgaacgaattaatgttttcatccatgtaacactttcttcctcatcatttattagcagtgatttttagaggtttatttggtgtatttttagcaggtgtatgtggcatgaagggggaccagtgtcatcttaggaatagctgtgtctgcttttcagatcagttgctgaatctctcaaaaagggctgcacagttgaacctgagggctttgacttggtcaccttgtacttcagcgacattgtgggcttcacaaccatttcagccatgagtgagcccattgaggtcgtggatcttctgaatgacctgtacacactctttgatgcaataattggcagtcatgatgtctacaaggtaggttaattagcaggaaaatatattccatagtgaaatttttatatgaggcccatccatatgtattctaaaattgaagaataaaatttatggaatattgttatttaggaataacaaattaaatagtacaccccttccattggtatatcactggaaatgagagccgggtagaatgcatgtaatttcccaatttacaaaatagcaactttcaacccagcaaaagattgccagtcagatttcttttgaactttttttctagaattgggactaagaagatgttgggaccaagagagttattgcacatcagtggctgagtactaatagtgtaggcagtactgtactaggcactgaaggggataaagaggaagtattggtgttttgcccataggtggtgactgctacagagttcatcttggtaaggtttgtgtagatctaatacatgctataaaaatttggtctcctccttcaggtactgttttatatggagagaacttgacattatagcagggaaatattagactcgaggctctttgggattgctacagggtaaccgaaaagctgcctattggtctgaggtctggggaagtgattaattgtggggtggcaagcccctgttcccaccttctctcactcctccagcctttgaattttcactctttctattagagtttgcaaaatgactgcattgactaattttgatgccatgcctccttacctttttttacatatgttgtcttgtctctaggcaaaaatgacgaaaaatctcatagctgtgcagggacatttctacattgtctgcatcatggatacttgtcttattgatggagaaagatgccccaggcatcctaaactttagacagcttctctgtcccaggaccaaagtagagctggagaatgagtagctccattcattggattcttcacagtagtctgaaatgttctagctctcaaatcacacacaagaaagtgtgtttatctcagattagacagggccttttcaggtcagatagagagcctcagggctaggccaagccacctaaatagggctcagaaataaacatcatacctgtcaatcagcaggagctgcaagctaatcaagaagcacacatggaaaccacgatgcaggaaaaatccatggaatcagagtacctgtcttaacttgttgaactcaagcagcctgaagagaaaaacaaatcactgaaagctaattcagttgaaactaaaatcaaagatgattcagcgtgggctgtaacacagctactggtttaatcaatccagctgattctgttcagacaattgttgggggtcttagcaataggccattagatattttggtacttaatggttgcagtagggagttaatgggctgttctcagaacagagcagggctatataaatccaaaaatgaaatttatttttttcagccctatttattaaaaacagcacagtgcaaaggaaataaaaattgaaccagcagcaaatgaccaaactcatttgtgtttttattttctttacctgtaaaatttgaatcacctcccctggtacttgataatctgaaatggaagtgagaaggctactgtagaattatgaagttagtgattcagtttcagttttcctgccactatctgcatcccaatcgcacccttttctaaacctccttttccctcagcacccttgtgttgactgacacaacccacaattttccacagcagtctgtacaccaagaccatgcatgcccatactccctgctcttctaatctcctcatccatatccttggggcctcctgggtgactgactcatcaaagctaaagggtcaacaactaatctctgataatggccagccactgacttccccttgcatgtagcatttacattgtaatccttccttcctgtgtgcaggctggcatgcctatctgagggtaggtatcctttcctcaaattgcacaaggtaagggagaccttggatggaaacatgttgaggcagaaagtcctatagattgaaaggattattgttattggctatagtaattcatgatgaggagcctattgctgattgctaaacttctttctctggagctgaatcatacccacagttccagggctggtttcaagatgtacctatttgataatgatgatgatgatgatgataatgttgatgatgatgatggtgatagcttgaactaattatatagtatcatccaataggcaggttttaaatgctttgacatatattaaattatttattccttagaaaaccctacgaagtttttactatcattatcactatcttacagataaggatactgaagtacagagagattaagtgatttgcccatggccacacagtttgtaagtgttgaatcttaaatgctaatcaagatggtataacttcagagtttcatgttcttaactgttgtattctgtgagtgcagttctctgggaacacatgggttttaactggattcaaacttgtagtaacacagtctgactggcgcatttcataaaaagtcccttcagcttagttattttttggatttacccaaaaagtttcaacttactggttatctaaaagtgagcacacttctgtggggaaggtgaggaacatagatttggctttatttccaagtgtccagccctaaccgtcccctgcaaagcagttgagggccagtactgctgctcctcagggaggtagcagtaggagaggaggaggtaactggtggaaagagactcagttctcatacccaataggcctgcaaaactaacttcatcgtattagcaaggcaaagcagagggaatgttcttcctttccccttccctatattttccttaaggctaccctagcttatttaccccaaataatctatagaaacatttgctgggaagcatcataggcactttctcctaagatgctcccccatggacaccctagggacagtcccagaaatctcccttttctcttctccccaaatgtctcagagcctggtatttttctaaggtcaatcaggagcctgtgaggtagctacacttatttcagaatctcttggtgtggggcctagacttcagtatttttaataaagctccttaagcaattctaacatgcagccagacttgtggatcattgacagtccctctctgcctttctcactttacaacaagaccacctggcctccattatacccttacagctctgtgctaaaaagaagcacaaataagttgtttgctaattctatttttcctaattcccaggtagagaccattggagatgcctacatggtggcttcaggcctcccaaagaggaatggcagtaggcatgcagctgagattgcaaacatgtccttagatatcctgagctctgtgggcactttcaagatgcggcacatgccagaagtgccggtccgaattcgaattggccttcactcaggtaataaccagttaaagtaagaggaaacattctaatgcgcctctaggaagactaaaaaagaaagggaaaaagatagctctcccctgattcctggccaccggattatccaggtgtccgggctgcataattcctttatgcctacccaaatttactctcctcccagtacctgcactaacacagtgggcagcagctccttgttccaggtactaaactcttttaatctaccattttggttagaggcaatatttccatgtttgactatgctacaagatcaacaggtatatgttgtagttaggataattcatttaattaattaaaatccctacttctgaattattttcctcccacattcattacctactagctcctcttgcttctgtatccactccccacctttttctctctgctctgctcttctaggctcctttccttcccccatccttttcacccctttcctaccaaacttctttaaaaaaatgaatgacatccactgtgccatttcttcactgtccactccctccttagcccctttgcaatctgacttcagttctcaccactttccccggtccttgtctgcctttacctctgcagcatctggaattcatgacaagcctccctaaaatgctcctcaattggcttttatgacatgctcctcactctgtgaatgctgcttttcactttatttactggttctcttgactcttcctgttctctaacattttctgcaaagctctcagtcttgtgatctttttgctgtctgcatgtctcacctctaatttattactcaacccacagcaacctgactttcatttcctaccactgtctgataattccttttgtctctaattgtcccttatattggtcttctccagtgttctgtcaggatccactgtttttctcctcctacatactctcatgggtgatctcattcatatctgtggtttaactaccacttgtacgctgatgacttccaactccacagctttagtgcagtcttctcccttaagcttcagccttctatatcaaaattcctgctgatatgcccacctgaatgttccacatggaccttagactcgacacatctaaaacaattatttttttacccatacaaacttcctgctcttcttatatttattctctatttcagttggtggtaccaccattgacctagttactccagttagtcttgagagtcattctctttgactcctcccttactctgacctttaacgttcaactaactactaagtcttgaacactctttaccttttaaatatttattgatctctcttgtctcttattcactctcacaacccaagcctgggacaccaagatctcttgcctggatcactgcaatagcatcttcttgctttcactcttgcctcttaccatccatccttctcatagtcatcagcataatctgtgtttccttgtctgtccttccattaggctttaagctccttggtggcaggaagcatatcttactcatgtttgtatccagagttcttagcacatagcaggcgtttgattttttcttttagagaaaagccctcatctgtcatttgtgcttcagtttcacatttccaacccccctcagcatacctcttcttgtagggttcaccattatttcaaatttaacatatttaaaacttcaagtcatcttttcccacaaatcagcataaactcacaagctcatggcaattttctcatggttgtcaatcagacagccaataaatctgttgattcttttacgtctctcttattacttcttcatggccatccacttcttatcattgcctccttttaagtactttgtgcttggattactgcagcagccatctggagggttttcctggttttacattttcccctttcaatgcattttatacactgatctgagaaaaaagatcatgcaattccttgctcaaaattctctagtggttcaagatcctccatcttgtacaacccacttaatccaaccttgtctccagtttctcgtgagccatgtgaactaggcagactgttctctctaagagcttcccaaattccctgtacaatcccaaccacaagcctttgatttatgtcccttttccactgttcaaatcctactcacccatcaagacctagatcaaatcctaccttctccactggacccttcttgattgagtcaggtcctaataagcacctcctcccattttctgagttattatagcacctctgtctgtgcttcttgcctcagccatatgttgtcttgggttactgcttaattgcttcctctttgatagtatcttctcttcaattagactataaattcctggagaactgagactatgtgttacatttcttttttattccccttggtgcctagccgtaaaaacagagcagaaggccaggcatggtggctcatgcctgtaatcccagtactttgggaggccgaggtggggggatcacttgagctcaggagttcgataccagcgtgggaaatatggtgagaccccctatctctttttaggaaaacaaaatcagagcagaaaccagaaagttgaaggtgaagaactttctggatactcccaaactgacttttcagtacggctgctgaagttttctcaattaccttgaacacttaacacagccatattaaaatgtaagaacaaaaaatgctaaatgcaaaatatcctttgattatatatacatactgcttttccatgccccaacacagataattgaaagtcagctctatttgttttcagatttttgaaatgttttagaataattctcttgatagacacagtttgggaaccagataaacccatgaaagcctttcttccaaccctaaggcacaagaaaaagtcacatttttttccttacaacaaacatgtttggaccctgaatccctgcccaggcctttctggtttgggtttgatacttgtttgtccctgttgacaaatataagcatctcaggtgtaactgttacgtggaacaaaggtatacatcagaagggcagtcatgtctgcattgttataaatttgctttcttgtagggcaaagagttcactactcattgtgtctttcttcagattcacagagctatatgatggcaacttttattcttttacaaagatacattccttcctctttgcactattcctctattagcattgggtgcatacctgttgactgtaattccaaccccctgatactctatagggccggttgttgctggagtggtgggcctcaccatgcccagatactgcttgtttggagacactgtgaacacagcttctcggatggaatctacaggcttacgtgagtacctaatagagagatggataggatggcaccactctgctattgagaaggtgattcttcttcagagaggtgaaagagagcaggatacttgatgtttcaatgttttaaagaaaaataaaagataatttgagaagattaagatttatcacggattttcctggtctctaatggcaaaccagtagggggtgatgttggactgaacatgtacctttctttctctagaaatgaagctgtagctaagtgacaccaaaacagccactcaatttgataaaaacagctaaaatagtattttgggtaaagaaaaaaattggccgggcttgtgggtttgtgggagtcatgttgagaaaagaactacataagggactaatattttccatttttcaactagtttgtggagacgcactgaagccagctgcctcccagctggctgctgtttgctgttgcagtcccctttttgaaccagttaggaccccaggagttctggcttcatcaaatagcctctacaatttagctagcaataatccctcaatccaagtagcttggaattctgaaataatttattgcaacttccctgtatataaaacccttagcttctatcaaaacagacatactatcaaagataccatttcttctctgcttctttgaaaagaaaactgtacaaaccatatgccatttgtctgttgtttgtaagatgctggctcaactcttactcggttatttactaccactacagaatcacaatgtgccttttgcttatatcatggttgagcaaagcattttttatgctactataggaaaagcatagagaataacattaaattctatatgcagttttcatttttcatggattttgtaccaaaaaagggaagaaaccacttaagcccttagaagggcttaactctggcaagacgagttcttcccaagcttcagcactgtactcaaactagtccctgatgttatggtggactgtatcacagtgggtggtgccctgtctgaccccacttcccatcactcatgtgtagaaacaggcttacacaatgggtccagtcttagtcaatctagcctgtgctgccatgattaaggaggcagtatggaacttagaagctgttgtcagaataaattttctgacatctgggaaagtcttcaaactccttagatatggcagaggccatggaagtagtcatccaggaactgctgcattaatataactttgcatatgactttactcttgaagtgcaacccaagatgaagtgaaatttatcatggaactgcaatgcagatttggcacagtattctggactgatgtaagcttgtagaaggctgaagtcatattctggtctgaaccagggaaaactccacacatttcacattggaaatacaaagttgagaccagaaattgaattttgagatgtagacagcaccttgcccagtgatcagctagaacgaagaaaatggagtgaatcacccacagcaggtgtttattaagcactgactgtgcaaggaagttattgtgaagcatacaaagaagtatacgcgtgtgctctctgtgctaaaggagctggttaatgtgcttttctaaaagctaatgactatgacccaaatatgacattaagctccacaactgaatggagatctgtagagaggtagcctctcctcacattggatatgaaatcaggacatgtcacatatctattaataaaaaaattatttcatcaatatctcctttgtgctcagttgaaaccactgagattctggaatggaagtgactcgtgacccagtcctggagtgattctccctaccatacaagtggatggtggttggtatgagctatctctcttttaagctgtgtgttccctaccatcaagattactctactgaaaggctccctgaagaccagatgcttgtgggatgcacacataggactggctaggaatatactggctgggcatgtgtattttaggaataggtcaaccttttttgagtaagggctttggatgatcatgagttaatgaggaaggcacaaacaaacaacagtactgagctatcaagagaaagaaagtcactgtgagtatacacagcagaaactccttgcagttctctcccgccatgccttcctactcaggttgtaatcagctttttttttaaaaaaaatgattttctcaagcatgtgtgaaaactagccttggacttttatttaagactcaacctcaacaaggtctcacttcatagggtgacagtttttagaaatgtcaaggatcttacctgagtgaacaagtgattattcttaatcaaataattacccttaggttctaaataaaattttaacgtggcagttccctatgtaaatctcttatcccagattgagatcattggttagaaaatagtacattcatgtgtaaacacagctaggtgcccccacccaaacgtcagctataaatgtacagtcttcataaaatatttgttgaaagagttcttgggatatttctcattgatgttttatttttaagtgtagcaatgttgagagagagttgtaagaatgcatatggaaaagacatcattttgcctaagatatgtaaagcatgagagttcagccatagtagcagcctgtgaaagaagctgctgaagtcaagctttcttcaaatgacgtcacgtttcagctgagagcacagtagatgctggtttctccatctcaacctttgagttaaattaacacctttctattgcatggcctttcatttaagatagtgtctaggaggctgataggtgctacaactaatgccttatttcggcctggtgaagaaggccatcactccgtctcctcctcttgtgaaaccctaagtaaacctctctcaggacgttgctaatggtctagttcatttacaagtgaagacatttattacattgacattttctcattaattttgccagtgagaaaggagcccaaatcatgtctctccttcttttgcagcttatcgcattcatgtcagtctcagcactgttacaattcttcaaaatctgagtgagggctatgaagtggagcttcgaggaagaacagagctcaaggtataatgtctttttgttttttgagccagactacttggatacacctgcttctggagaggtcatggtctgctgaaagagtttacctgggagtctgagactcagagctataacttgggcagaatcttcagccccatttggggttcccaaaagattgctccattttgcctcaattttcttctctttaaaatatggctacagtggggaggagtattgagattttttctgcatttttcagactgtaagttgtatctttctctcttaaagaactgcacagaatttggctttccaatgagctgcactattatttacattttctaacctacattttttcactctttggcagtgccagacattgttcaataagccatagtaattgtgagtttggattttctattcactttctcagtggccacccttcctgggtgaaaggcacccattggcacactatttgcagagagactttttctttccctaagaaaccaggaggaacaaagtcagtttctatgaaaggcaaacattttgtagcccctttttccctgttagagttatcactagacctgagatataggattagaataattttagttttctttttttgccatttccactgtgttctatttatctatttctgaatgaccaaagaccaccggttgacccagttgtaaaagagctcagtgataaaataatgtaactccctcattttcagatgaaaaccaaggtccagagaggtgaagtagtttgagcagggtcacacagtcaactgatagcagaatcaggtcaagactcaggaagcctgacttcctttttagtgacctttccatgacaccatgctgcataaagatgattttctcagtgactatttttgggcaaagcaagagcagggcactaagtgatgcacaattagcttctgactttggcattccttttctaaacagtggcaagttacatgtagctagatttcagatgttaaagtttggaaggtctaactctagttgacaacttcctcctatggctagtcctagttttttccttccaataggtcattagtatcttccaggaggttggatgagtcacttacaaggggacagaggctcctttcccacctcttgcagagaactcagacagtaaaatgttggggacagggatattacttgggcagcgaatctaactgtccaaagcttttgtgatccttctatacattctgtcatatttcaacagaggagtagaaatgcagcttggtttcctgaagaccttttcctctgcattgctgggcagaggcccctcatttaaaagctgaagggttgccacttttgaaactgaaaaacgaaaatgcatccctgtcccaatggtttttattgtcccacaaattcaattcaggagcactcacatctttgggtgtttcaagtacaaaatcaggacttaacttcaaaagggccctttgcagcttcatggtttccccaaccccagggaatttgggaacatttcacagcaagttggaagaagagcctttctctgatgccacattgggcctggattattgttgtggcagggtccttatgaggaggagacattaagagggaagagaagagggcgcctcagaggaaaggaaggggcaagggaacaaggaagaggagaggaagtaaggcccaaggaaaggtcaggagaggaggagagatcctttctgtgtctgtaccctctacctccccaccagaaacaggtgttgtactttgcatcataagggctggggcacatggggtttctggtccaccagggacatgcaatatacccccaataagaccatgtcgccagcacacttcagaaattctgattcaatattttcactcctcatccactctgtgctactggaagcaagagttgctctagtacatggggcagaaatatcacatttgatggtgagcccggtgtgatttcaaagttgatggctagaaatgtcttttccttccagctgactgatgtttgaaattcctccattaaagccttttctcttgggctcaaggtttatatccagtaagaaccttcttccctccacgccatctcctccactaggttgatgacactttacgttatttcccttagtggaatcaaaaacatggattaattgggtgagagaggagaacatagggcagttgagtaattggctgggttgaggttacaaagaaagagaccaaagtgaggaagctgaagtagcttgggggaggactcatttagagatgagaagctcagcctcttgggcccactgcccattgcccacttcaagcccctcttgtactatacaggcaacaaattatcaatgcctaactggccagttctactttttcaatatttctcgccttgtgggctagtgataaatcactgtattaccttttctcgtacatgagtcctgtttcagtcactatttttctgacaagtgtggggctccttgctgagatttttgtatatatctaggcttatcagctgtatttaccagaaacttttaggtagatttacattctggggagactttctcaaatgactgctcttcagccagtttatgttgttgccagaggtggacactttaaaaatattttgtaattttttattgtaaactgacaattaataattgtgtactttatggggtacaaagtgatgttatgatttattaatacaatgtggaataattcaatcaaactagttaacatagccatcacctcaaatacttaacattttttttttgtggtgagaacatttgaaatgcattcgtttagtgattttgaaatgtacagcattattaactatattcaccatgatatgcaatagagctgaaaaaatcacacatattcttcctcactgaacagattttgtgttcttacaccatcatctgttcatttcacccacctttggcttctgtaaccaccattctactctctgcttctattaattcaattgttttagattccaaatataagtgaaaacatgcagtatttgcctttctgtgcctggcttatttcacttagcaaatattcttcaattccattcatgttgtcacaagtgatagaatttctttctttttaaaggatgaatagtattccattgtatgtatacactaaattttttttatccattcatctgttgataaacaggttaattccataacttggctaatgtgcctagtgctgcaatgaacatgggagtgcagatatctttttgacagactgattccaatattttgagtaaatacccagaagtggaattgctagatcatatggtaattctactttaactttttggaggaatcttcatgctgttttccataatggctgtactaatttacattctagaagtgggcactttctgaacttgtctttgaattctggggttaaacagtatttggttctcaggttcctaagtattagtatttgttttattttccccagtctttcccactcatatcccaaccccagcatacacacacaagcagtgtgtgtatgagcatgtctatgagcacacacatgcacacagacaggcaattaagaaatagtgagattgtactgacagatccatgaaggtcagaaagttttgcctcaaattcttgccccatcactgacttaatgtctgacatcagacaagtaatttcaccctctctctgtgctttcgtttgtccacatagaggcctcatctgacttgtggttatcaggaagctcattaatctcacaagcttcaaatttcccaatagttgctttttggcctctagatctgccttttgactccagtgtgttggagaagctttgtggtatggaaggaagagcatttaaaatttggtgtctagtagagctggtttcaagtcccagctgtgcctatttattgacaagtcatttaatctccaggaatctcagtgtccccattcgcagaatgagattaataattaacctacattccagatttttgtgaggattaaataagataggagataccaaaatgtctcataagcatcatgccaaagtaagatgctcttatatgggggatctctaggactgcttggggattgatattgggtcaaagagtttggttcaggctttagttgttgccatacttgttttctctctttttctccctttagcaaaattgtggaagtcaggtaggtaaacagagaactgggattctaagaattcttttggatggactccaaaacctcagagagcccctggagctcccctgcatactctttgatttggaagcttgcctgagtccataacacttctatcctcttttgcaaccattagttttggcatcccagtgtgtcctaagacccacccaaatctttggacaatccctctacaaagctcccttggggattggcatgctgttctgttagcctctagatctcaagacaaacagtcaaatatggctgagggtggggggcccttgagtttgaactttaatagcatgtttttccaaaataagatccagtggtgtcttgagtattccaagtgcacaagggctgagagtttcaattaatgaaacagtctgattatttactgggcaactgtctgtataagacactacactaggtactgtgtaaaaagaaaaagctttggaatcagaggagttgggcttcatgtgtttagaacctataacatggcctaatggttgtgtttaactgtactgtgagttccttaaggatggaaccatctctgtattcccagccctagtacaggaggagtggaataaatgaaagaatgagtgatggaatatattttcaagttgcttacctcttctgaaaacagagtgggctcaaatagtccaattatttgaactatttgaggcttagggagagtctgatgccagttaatggaggttggactatagtggtatgctctttctacttgcctcatagaaggcttgttcaagccttgaatcaaatatttgcaaaatgctttgagattctccaattaaatgtgctaattattatggtttttgtcattattgttaagggataaatatatgtgatataaaatagggaacagtggacttgatatttaaaggggtaaatctaattggaatttctaagttaaacaattcagaactgctccaaatgagagctgctgtgagtgagaccatatttcagattaatgagttggaaacacatcccattacttttctcagtcttggtaaacacatttttttcttatggattagaggaaatgagagaacagatgaaagagaattgaaaggaggagagagaagcacattgagaggaaagtttactggaaagagagaaaggcagaacagaggcagaaaatttgactcctctgaggtcatcactcaggccctggggtgactagcttgagtttacactccttttctcttctgagacttgtggttcttgacaaccaagtaactgacctatagatggaggccaacctggagtcttaccctacctgtaagagtcccttggctggaagaaaagaacactgcacaaatgtagacctctcaaaatagccaggataatttaggcttaaaatttaacagcctgttttccatttctactctctttttgggtttggtgagagccattgaatgagacggtaagcgggtaggtagaatctgaatatatgtactctagatacagaagacaatggcttacctaatgccaaaagatcagggcacaaatgataagcaaaatcttcaactgagcatccagacatttggttgctgtcaagccaaacatccacacattcccaatgatgaagctgtatggtggcggtagacaaaacatctggatgacagcttgatatagtgttcacttttcatctggctgctctggctcagccccgtagggaggaagactccagggagtggtgaggcaatttctgagccaacctgaatgcttatattcttttggaaaattgattatagcaggcttaagattttttatgttttctataataagggcaaaggcacagaggaaaccttctggctgattgggaaaaaaggcttcatgaagccccttcctgtgcccccaccagtggacaaagatgggtaagtggagttcacatttaattggagtcttcctatgccatactctgccacactttcttcactacctatttgatgtctcccctgccctgcaggcaagtgggccatggcctgcaaccagtggagattgcagccttccaaagaagaaaagcagaaaggcagttggtgagaaacaagccataaggtaatggccaggaggaaaacagagcacagcagcttgccaaattttcaaatctggggcttcctttggcatgcgtgccagtgtcagcctatactctgttggcatagtgtgatggagctggagaatttccaagctctaataaaatgggtgaaaaccttgttgtggggaggcctgctgcagggtgagctgcacctgtgggaaattgtctgccctggcccgagagagacccttacctcttgccctgacaacatatttgaatgctaacaaagctggccttgctatccaattatcaggcaggtacacctgtctcttttattgttgagcacctgggccacatggtgagccacatcagatctttagagacttacatctgtctaggcaatagcagtaggactaccggctattcctgggatctgttgacaagaccaccttggaggggatgtttatgtcatttcctccggaggcactgcctgatccctttcaaaggatcaattttgccaaccaaaataagactggctactctttgactgcctggcttgtattcaggacaatttctcccatccttcctcccctactaggatggtacaattctgaagcagcaacaaccatctaattatcaagaattctctccacatatttatcggtatttatctctgaggaatccattgtgttcttgggctcttttcagtatctcttctcttctttatcgtgtttgctttttttttttttaaatcttgctttcttattctctcttccatggaaactttggccctgaaacactttgctccctccacatatccttggaaatcacaagattctaaggtaaacattaaggcatctccacatactcctgctcccttgttctctaacatgtcccaaaataatcacaattctagcagccactactaaaggcatccacatactttcatattctcccactggcctctgatgactttgttgattctttgtgactgtttctgtcctaaggaaaccccaatgcatcttcatttctacaacaataacaggtactctgaactagtcgtaaacatttatgcatcacaaaggcttctgtattgagtgtgtggctcttctgcagcctcctgaatcaccctctgactcactgacacctggggccaggatttgttctacagtcttccaatttccagaaacattctttcctgtgattagggaaacacaggaacaacctctgacacagacagacacacacacagatccagacacatactctctagcctctctctctctctctctctctctgtaggaaagtgtttggaagttcttgaaggatttatccctttggaagggtagtgtggcattggaggcactgtacaagaatccatccattcctaagaatgtgttggagtttgcagcagaaaatactgcaactcacttaccatcattggctgtgtgattggtagtgctttcctgacatgcagatgcatgttgcttaggtcatttgtaaattcactcatctggaaccccttgacagagggccagcttctgtgtactgtagatatatggaacagattgaagccactgggtcaagagaggaaatccatccctggtcctggcctcattaacacatgtacttcaatcagcatgttaactgaccacatggccttggtggcctatacaaatcacaaaaatccccaagaagtacatccctgacaaatttcagaaggcttgtcctaagtccaagcactcctctgttgctgttacttgctaacaccacctattccagaatgtttccaactttctgtgaatttacaggctgacacttactgggatagacccaacttacaaaagacctatgatacctatgaatgccactgacttgctgccaccatcataagagatgttgaggaaaaacttgaaacctttaagagagccctgtggggttggccagggaggaagaaaaactgctatgaaagggggcacagctttggtgaagtgattacaggggctgcctctgaagcagggccctacacgtcacctgataactcttatcttgtgtccccaaatatccactacttctcaaacctggtttttgtatcatctggttactttccataaaatttcacctactgaggttaattttgggctgacaagccccctcttttaatcatagatgtgcttttttgagggtgagaaacaattaatcacccatatcataatgaaggtgaactgagctaactgttcaggaggacttggcagtttcgttttgattaggacaaggagaaatggggaagttggcagttttgaagaatagagggtcacactggcaggcttgggataacacaaaagcagtggatccctgggaaatagaagaagggtgaaaataagtatgaaggtggaaaagttagcttagattccacctcttttaaaccttttgagtctttattggactcaacgaatggagagaaagcacattttccttctgctatcaggacccaggactcccaccagagctttaatataactctgctccatgtgggttaaatcagcctttgtggactggctagaaacctgaccaccacacatatagcactgttactatggaggaagccactccaagttccaaatcattgatttataaatgtgtagaacatacctcattagtaagttgaagaccacctgtatattaacatgctctcttttttgttaaatttgtaaaacccttgtaaatggcaatgtctaattttgcaaacctgacacatgtaataatgtttatttgtttaacaatccaggaaagttgagcaatttgcaagctgtttatggaatatagtagtggtgtggggcttggaatcattcatattgaaatcctgtgaaaggcctaggatatataaggtatggttactgttttctctttctctcgcccaggggcaaagggctccaggatttgaatcttctcttggtgaggcaatgggaaagctcacttcagttcaagaaattgttctgcctgggcaagaaatt

SEQ ID NO: 4909 - DNA, 109166 bp, human; identical to SEQ ID NO: 4908

SEQ ID NO: 4910 - DNA, 1814 bp, human
gcagtgggaagagctctgttaacaatgcaatgttgtgggataaagttctcactagtgggattggccatataaccaactgcttcctaagtgttgaaggaaccgatggagataaatcctatcttatgacagaaggatcagatgaaaaaagagtgtaaagacaattaatcaactggcccatgcccttcacatggacaaaaacttgaaagctggctgtcttgtacatgtgttttggccaaaagcaaaatgtgccctcttgagagattacctggtgttagtagacagtccaggcacagatgttactacagagctggatagctggattgataagttttgcctagatgctgatgtctttgttttggttgcaaactctgaatcaacactaacgaatacggaaaaacatgttttcacaacatgaatgagtggctttccaagcctaatattttcattctcaataatcgttgggatgcctctgcatcagagccagaatatatggaagatgtgggccacctgctgaaggatttcaggcaagattacaggaatttcagaattttgaacaaatctttgaggagtgtatctcacagtcagcagtgaaaacaaagtttgaacagcacactatcagagctaaacagatactagctactgtgaaaaaacaatggattcaataaacatggcagctgaacagaaaaggcattatgcagtggaagagaaggaagaccaaattgatagactggactttatctgaaaccagatgaaccttttaacactggatgttaacaaaaaaaccagggaggttactggggaggtggcaaacaaagtgtcatgtgcaatgacagatgaaatttgtcaactgtctgttttggttgatgaattttgttcagtttcatcctactccagatgtattaaaaatatataaaagtgaattaaataagcatatagaggatggtatgggaagaaatttggctgattgatgcaccaatgaagtaaacaccttagtgcttcagttccagcaagaaattgttgaaaatttgaagccattacttccagctggtatataggataaactacatacactgatcccttgcaagaaatttgatcttagttataatctaaattaccacaagttatgttcagattttcaagaagatattgtgtttcatttttccctgggctggtcttccctcgtacctcaatttttgggccctagaaatgctcaaatggtgctcctaggattatcagagcctatctttcagctccctagatctttagcttctactcccactgctcctaccagtccagcaatgccagataatgcatcacaggcagaactcatgattacattagtaacaggattggcttctcttacatctagaacttctatgggcatcgataatgttggaggaatgatttggaaaactataggctggaaactcatatctgtttcattaactatgtatggagctttgtatctttatgaaagactgtcctggaccacccatgccaaggagagagcctttaaacagcagtttgtaaactatgcaactggaaaactgaagatgattgctagctccacaagtgcaaactgcagccaccaagtaaaacaacaaatggctaccacttttgctcgcctgtgccaacaagctgatattactcaaagacaactggaagaagaaattgctagattacccaaagaaatagatcagtgggagaaaatacaaaacaatttaaagctcttaagaaataaagctgttcaacttgaatatgagctggagaattttactaagcagtttctaccttcacgcgatgaagaatcctag

SEQ ID NO: 4911 - DNA, 64709 bp, human
cggccgccaggggaaccgagcgcccggcgcggagagcgcgggagcggagcagtagcccgatccggggccgcgggccgagctgccggtgagtgaagccccgaggggcgcggcggccggtccccggggctgggcgggaggcgcgggaggttgcggcgccggggaggagggaggggggccggctttagtccaggggccggctttagtccagcccccggctggcccggcctcccgccttccctctggcttcctccctccgctgcctgcgcgaggggggcaggtcccgggcgggccgcgggctgggggtggtgctgcccggagggcgggcgtctagggccggagggtggagctgggggttcgggggtgtacccgggggcgggaggctggacaaggacggctctaaattggctggaggggcccgtcggcggcgaagttgctagctgggggcagagacggccacgcggttgcaggagtaagagatccctctgtggcgagtgcgtgagacgaggagtccggcgtccctgccatccccgtcgccctccccgcctgctcggccccgctagctcctctccttgcctccgcgtgtcccctagctctgaccccttttggctcccggttcgctgccgcagcactgccgggtctccttggcccccgccctgaccctttcggcctccggcttcccctgacccctgcttgcttcgccactgccccgttcccgttttcttccctcgctagttacccctcccgcttcctaattcccggtgcaattgcctctttgagacctcttttttttttttttcctctccttccttttagattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaagtgataagagtcatttatgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctgaaccctaggaacgactggcactcaccctggctgcccctcccttccagcccagcccaaccctgccgtgccctgggctttcacaagcaggaattccagccccagccaggtgccctttctgaatcacatcagtggaccatgacccagctcccttgccttctgtggtagttaatttcccaggggcctggtgacactctttcctggaggtggtcgcataaactttctcatctacactgtggtactttggggaaatacttttacaggtttctcttaatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataataccttgcatttatctaacaattactgtttataagatactttcatatacattgttacttttagcttaggcctggagaaagggatgttaaaatgtttcctgcaacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttacccgcttttggttcactgtttgattttcttacttcctctctccttgctaaaagtgtagaatgacacacactcagaaagtcctgagctttttgtgaaaccccttgcaactcactgaatacacactgttgcattccggttgttatgtgatgaatttgttttagagaagacctgatggatttgagaaacttggctttctgttttcccccttgacttcacaccagacacacctcctcattctccatctgttgtctggagcactgattatcattcctgcttggaattgaagttggtgggtaatgggtacaataagggatccagccatctgctgacagcttatcagatggactgcgtcctgtgtcatcagtccagggggatacaaggggatgatgtttatatgggcctcactagtgaggcatgacattcctttttagtttgtttctccccccaaggaaatttgcagagaatttttccatctttcattgttacagtcattgggggtgtccatataaagagaggtgctgtggattggtgaattaaacaacccacaggcagccccaggatttaaaattatgatgctagttttgctcatggcttgctacaggaacctcagcaaactatttaaccttttcctatctcagtcttctctgtgaaacgggccacatggaaatgaagcatttgaattctctgaataattatgtggtcacttaaacagagaagctgggcaaagctggtcaaagatggcagatgaccaatacagtttcaacttcagactcagaaaccgacaaagctcaactccttatacctttcttgatagcttctagaaggcattcctctaatcatttttgttacttttctctggatccttgcctgtgtctggatacctttctgatgcatggcatataaaactggacactaactcttaccagaggtccagcctacaccaagcagagaggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcctttgacctcactttgagagatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaatgaagtgtggtgccatctttctacctttctttttcatatctcttcttccctgtttccaagtctgtccacctgatccaccccacacaagttccaaaacaatcctttctataattcaaaatgcccatctcatcagaggagatgatagccatgggggattaggaagaaagcagttttatttcagaggttcatactgaaatgtgagtggacagactccactgggcgtcagggagaggatgagttttaaaaaagggccttgttaccctaacattatatctaattggtagactgtgtctagtgtttttaagcagatgtcctttctcatgtgccttgctcaggttttggcctcttctctcccgctaaagcccctgatcaggagaactggagttatccatgccttgccaccctacatgctgacccccagggtttcatattaatgtaaatctccctccacagtgcttggatgcagcagttaatctgaaggcctggcgaggacccctcttctgggcaccagtcagtcctctgtgtttactcagctctttcctggctacacagggcagcgcttgcacatctgtcagttcatgggcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctccttttcaagactttgctctggggcctcgttttcaagactgaggtctggggcctaagccaccaatcactagagaaggatccccttaagagcagccttctggggcctagaccttgatcatgtgatttcaggccttgggatgtggggggtgtgctgtatcctgccaaggccattggaaggcctctgggcatattcccaagcattgtgggtaagaaggctgtttcttagtcttggaggtgggagaattgagaaagctaaggtcatgttttctataacctggttcctggaagaggagctggtttagagggcatttctaaacaaacagcaacccaaataaacagcagcgcttggaaattagttatgaaagttcacacattctaagacctagggaagattgtaacaaagggtcctcttcatatcagcacttgttcattgttggtttgcatttgttaagagtttccttttttaagttccaggaacttgagtgtgtgtgtgtgtgtgtgtgtgtgtgtgtgcgcgcctgtcactttattctctgcaccctgcaggaatgttgctcagagtcatgtgcacaagtgcctcattatcagcagcgctttcacacttggtcccttgggctgccactgctactggctgctgcttcatgtgggtatttctacctatttcctggagccccagccccacagggaatgttggcaccctgaggaaagggaccgcctctacatttggatctcccttctgctgcagggcagctgactttactctgctttcaagttcacctttcctcagaatagccctgcaagctagcaccaagccaaggttatgtttccttgcttgcatgtggggtttctggccagtcagccaagtgaactgattgacccccagccctgtggggaatttcaggggggtattgtcttggtcatcggagtcaggggtggcctttaggccaaggctgcattagctttgtggagaagaatgtgaagcccgccgtgtcacagggtctgctgaccggctgggtagtgtttggccatatctcacagccagtgctgtgtttgctcagatggacgcacatggaaaccaggctaggatcatcttcccaaatgtcttactccctgctttgggtctgtcctgaaaaacaatttgcaaagtacattgtggtctgcacctgttgttttttcatcccccttttccacagtcagtttgcagtgaatggaggattaatcctggctcttgccacttgtattttctctttcccttctttccttgacgttgggttcttgcttttcagttataactgtctgtggacattaaggacagctggtgcccctgatcatttaggacctcccttaggcctttaaaacgctggaaatgtgtaacagggccggatgggcaaaaaagagtcgaatttaggagaaaactcactataatttctggttatctttgtacactctcagaaaagtgaggagtggtagtaataacacttgtaacatttttgaatacacgttaattatgctttaggcatggtgcttagtctactgcctgtgtattacctcatttgcagccttccagaaaggttgttttttgtttcatgtaattttttgtttttttgaaacaacgtcttgctctgttgctcaggctggagtgtagtggtatgaatatggctcactgcagccttgaccccttgggctcaagcgatcctcttgactcagcctcccaagtagctggaaccacaggcacgcatcaccacgcccagctaatgtttttgttttttgtagagatggggtcttgccatgttgcttaggctggtcttgaattcctgggctcaagcgattcttctgcatcagcctcccaaagtgctgggattataggagtgagccaccacacctggcctgttttatctaattcttcttttctttgcttctagctgatttcccctttggtagactataggcactggatgttctagctgtactttctcaggttgttaaaatggcagagtgataccaaatcagagctgaaagaaacctctgagaacaactaatttgtttctttttcatcccttgttttccagatgagcaaactgagacccagagaggtgaagtgatttgcccaaagtcacacagctaaatagaagcagagctgagtctcctgactcccatttcaatatctctctataataccacacatggcctccttctatccttaaccttccagcatgaaaggaactagacttttcttcttgctcactattagagaaatggaaatcttgtgctttttgagcatcattgtttattgccttcttgaaagtgaggatctcctggctgcaggccacctccttcctttctttctttctttctttctttctttctttctttctttctctctctctctctctctttctttccttccctccctccctccctccctccctccctccctccctccctccttccttccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactctatctactactcgaccctttacactactgccagaatgatacaagtaaaatacatgttggatcatgccattcccttcctccaaaacctttgataactccttaatgccttcatcagggatggtaaacacatagatgcatacactttatattgtccctggccgactgtgctaatcaatcataggcacgctttcccagggagagtccaagtagatttaaaatctgtttagcatagcattctaggtagccacttatcaatcagtcagagctggtattaatatatagactagggatggcacatagataaagcctgtagagaaatcttaatctccttatgataggattcggtatcttctgtgattttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgtgtgtgtgtgtgtgtgtattgagtgatatctcaatatagttatttcctcctctttattcccaaagccttgggagtggactgcttgtaaagtgttggtcccatagcctgctagttagttgtttacttgtcaagagagatctaagatgtaagattctcaataatagtaactacctttattgggccttttcagggataggttttcagacttactctgaatcatacagcttgtaggatgggtgccagcactaggacccatatctgccccttttgagcagagtgcctggcatataggtatttgatcattgtcacatgatgtgacaaggagctttgtttctttgtgcaatgcttctttttattaaaaaacccagcggtggtaaaatctgacgtatttgaaaagtctggtgggagagaggtttgaggagaactgcctggcattcaaaaagcttatgatatgttagatagtgtgtggtgaatctagatcacataacatgtattaagcaattactccaggcctagtcgtactagagagatacaaaagtattagatgtggtttctgcccccagggaacttattatcaaggctcattaacagtctgactactgtattttcaggtggcaagtatgtacagaatttatgaccagaaaatgctagagatcagagaggctttcaagttcctgaagttcaagcccgtcgttttgcagatagagaaagaagcccagagcagaaagctgcttgctgaaggtcacaccacttgggaatggcagagccagggctggtgtatatggccttaccctttgaggtcctattacactctgttctgtcgcccttgaaggacaggtgaacctaatggcctgtgttaaaactttaacgatatgctttatgcctccaggcctccttatggtttgggggaggggaggttaaattttagtctttcttaaaaccttgagtgggaagggccagcactggttacctctggctcaagcccaagagttctaaagatggctaattttccctttactgagacaaccactgattctagtctaattagggcactttcctactcctcctaagggtctttcccaagctcagtgtgtttatgacttttctacttcagttcctcatttttttttttcctttttgtgaaactcaccttaaagacaagaggtgcctgtccttatgggtgggcctgagagttagaggagtggggccagttcctagtgatactagcatcaggctggttcttttggccttgtcccctgctacttcccaagccagaaatttagatccaagtttggggctttctcagaaggttcaggtataattcaaggtagaggtattcttccttccagacccctctccccacacagttagtattagggtataattctagtcaccactaacatctattgaacgcttaccaagtgccaggcatcctgtggaatagatgctattatttgcattcccattttatagataagaaaaataagggtcagggaggttacgtaacatacccaaggtcacacagctagaaagtgaccaagctggtatggatgtgtagatctggctgactcgttactgttaggctaatggagcctaacatgaaaataagttactaattatatttttgtattgacgaagaaccatttgccaattttctgcaagccaatttaaagaactggttgaaagagaagcatcctacctatagttctgttccactgtggggtggactgtatcaagaggcttgccagtcacctgcatttgtcaagtaagtcccttcccttctctgagattcagtttctgcctctgtaaatgagagggtcagaccagatggtatctaagaccttttctggcttcatttgctacttcctggtagaatggaaaaattgtagaattggatgaaggacacaatgcattagaaacacaaatgtggagagaatacatagttcatcacggatgggttagttagccagttacacactgtttctgttttcccttgtgaatttataatgaaacattttttttttcttttcagtgagcttcttgctaacatcagaaagtactagctttccttttttgttgtttggttcttttgtttgttggagacagggtcttgttctatcactcaggctagatgcagtggtgtaattacagctcaactgtaacctcgaactcttggactcaagagttcttccacctcagcctctcgagtaactaggaccacaggcacatgccatcgcacctggctgatttttaaattttttgtagagacagggtctcactgtgttgcccaggctggtctcgaacttctagcctcacgtgatcctcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttttgtttgtttgtttttgtttttaatgttgctcagtcatgccacgaaatgggtacctcctaaacactaacttggataccctgctggtttgctgcctttcagttttctattcacataattattgtttgcattcccattctaattttggcctctggtctcagtaagaaggagaattgaaatactcagtgtcacactcattacacccacgaccctcattcatttcacaaactaacctcctgtatttcttctcttcttctggcttggcatagggcttttgacttagatctgagctcaaagctaatttctattactcatgagctgtgtgcctttaggcaagtcacccaatcactgtcattatgtttttcatttgtaaaatggagctaaaaattctatctacctcttcaagttatttagagaattatgtgagttaatatttctaaagctctgggaacactgtgtggtacatattaggtattcaaaaaatattagttacagtcttcctccttgctccccaagaaatagagccagtaacaacaacctttcttctaatacctcatgaacttctcctggcattagctgtctgaaggggctgaggtttgccttttcttttgacgatggagattagtcattagaaactctggatttcatcctcacaggaaacttgaagttgttgacttttgttccttgttaaagagttggtacgactggggcggaaatctccagagaaaagggcgtgttcctctactaattactctgtagacggcagagggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcaccttgatcatgatatattatcttttttattgttcctggatatggtttgctagtattttacatggtattcttaaacactgtgagtgggctgggcgcagtggctcacatgcctgtaatcctagcactttgggaggccaaggcgggtggatcacctgaggtcaggagttcgagaccagcctgaccaatatggtgaaaccccatctctactaaaaatacaaaaattagctgggcgtggtggtgtgtacctgtagtcctagctactcgggaggctgagacaggagaattgcttgaatccgggaggtggagattgcagtgagccgaggtcatgccactgcactccagcctgggcgacagagcaagactccgtctcaaaaaaaataaaaataaaaataaataaataaataaaataaaataaatctgtgagtgaatctggctctagttttcacttttcatactgcctttgtcaggttttcttattaagtttgtgctagcttcataaaatggattggccaatgctgcttcctcttcttctaagctttggaaaagtttgcatgagatcagagtgatttgtttcttaaaggtttgttagaacttgcctataaaactatctgggctttgatattgtctttgtgggaagattatggactactgattcaatttctttaatggttataggaattttcagacattgtatttttctttagtcagtgtctttaatttatgttttgctaggaatttgaccattttgtctaaattttcaaatttattggtttaaaattgttaatagcgtcttaactataaacactacagatatttaaaagatttcttccttttctctcatactattatttgctactaaaaaatcaatctcactagtagtttgtaagttttatttatcttttataggaaataattgagactttgttgatggaactgttacatgtttgttttctattttgttaattgctgcttattttaaaaatctgttttctccttcatattttctttggagttatgtctcttgttcttttcctaacttaggtgggatgcttagcttatttatttttagactttcttatttgactatatgaattaaaaggttaataatttttgctacctactgtttagctacattccactaattttgatataacattttgttattgctcagttccaagtattttggaatttccattgtgctttcttaactcatgggttgtttagaaggattaacagttttttcctaaatgttttaaaagtcatctttttgttgctgatttctaacttaataacattgtgatcagagaatgtgatctgtatgttctgtttctttgaattttgttgagatttgttttgtggcccagtatgatacagtgtccactagatcaaccttgttaattttgctgctcttcaatcaccttaccttattttttctctgcttaatctatcagttactgggagattttttaaagtttaccaccacagaggtagatttgtctatttcttcttttagtactgttaacctttactttatatatttttgaggttgtgttattaggtatagtatgttaatttttgcatttattgttacatctattgatcaaaatgttcaatataggggtcccgtggcaacttagagtgtggatagatctacatgctataagggtggcttggtaatggtgaaagcatccctctgggtgggctgggtaaattggattttcagctccagggaagaaacacccttaaaatcaaaattgcaccttcttgaagagttcttaaatttgacattgccaaacaaaattaacaccctcatatcctcaagtgccagaggcttttgtcgttattgaaaacactcttaaaagctgcattccttctgggatgcatgaggggttgggaaggaaagctttatttttcatgggccttacagacattacttctggttggtcagacatgtttcagacccttggactttcttcttcttactgcctagtattttctatgagacttgagccaaatcctgttacctctctgccttttaggttcaatgactggttcccttttcccctgacagaagtgaggtgtggagaaattgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgccatttaaaagatagtacattcactgggtgcagtggctcacacctgtaatcccagcacttttggaggccgaggcgggcagatcacaggattttgagactagcctgaccaaaatggcgaaaccccatctctactaaaaatacaaaaattagccaggtgtggtggtgggcgcctgtaatcccagatactagggaggctgaggcagtagaattgcttgaacccaggggacggaggttgcagtgagctgagatcgcgccactgcactccagcctgggcgacagagcaagactctgtctcaaaaaaaaaaaaaaagaaaaagaaaaaagaaaaggtagtacattcttttcaaaaggaactattatgatacattgtgtcttataatttttaaaaattttaaaattttttattatactttcagttctgggatacatgtgcagaacgtgtaggtttgttacataggtatacatgtgccatggtggtttgctgcacccatcaaccctttgtctacattaagtatttctcctaatgttatccctcctcttcccctgcaactgccgacaggccccggcatgtgatgttcccttccctgtgcccatatgttctcattgtttgactcccacttatgagtgagaacatgaggtgttcggttttctgttcctatgttaatttgctgagaatgatggtttccagcttcatccatgtccctgtaaaggacattaactgattgttttttatggctgcatagtattccatggtgtatatgtgccacattttctttatccagtctatcattgatgggcatttgggttttaacattttttaaagagttgaggtctcactctatcactcaggcttgagtgcagcagcacgatcagggctcactgcagcctcaaactctggtgctcaagctatctacccacttcagctttccaagtagctgggactacagatgcacaccactatgtccagctaatgttttatatattttttaagagatgggggtctcactatgttgcccaggctggtctcaaactcctggccttaagtgatcctcctgcctcaacctcccaaagtgctagaattacaggcatgagctgcagtgcccttccctagtcctcctttttataataattttaaaaaggtttttttgcttattgttattatttttaattaatccataatattttatatatttttgaagtacagtgtgagattttgatacacgtatccattaaccaatgtctccctaatccctcctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttctaccctcctcggaaacttctagtgctctcagttacttacaaaataaaatccagaattggtgagctgttccttaaggctcttcatgatgtggaaatagacctcttagaaaaaggttgcaaaagcaatgcatactcattatagaaaatttggaaactaaagaatttggcaaactttttctgtaaagggccagatagtaaatgttttaggctttgtgaaccatgctgtgtctgccacaactactcaactctgctattgaagcacaaaagcagctacagataatgccagtatgtgagtgaatgtgtgtggcagtgttctactaaaactatatacaaatcagtcagtgggccacgtttggttcgcgggttattgtttgctgaacactgctatagaaaataaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctcaatcctatctgtattcatgtacctgtctgtggagtcctccctagttcctcctactcgatatgatctcttgcctttgaatccctgtagcactgtgtacctctcttgtggtatttatgtctttctgcccctttttttggttatctctgtactggctttatgcctatggcatggacactgggtaatgttatctttgcattgactcccagagcctagtagagagcttagtgtacaatgggctgattagcctatcagagctatgttgaaaggtgcctaaggtctgctgcagatgacctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaagctgggtatgtatagtgacccacagtaacattgacattgtagttttctggaattttggagaggcagtctagaccctggtagagccgtagagagagagagagagaggggaagccataagtttggttcaaaatggaaactgattccagcgggaggtgtatgttgtgagaaaagggagatgatgccagattggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacaggcgtgagccaccgcgcccggcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcctcccttttgggaaaacatgctccatttaaatcatacgtagtaagtcttcagaaaccctgaccctggaggggctttgggacacaactgacaattaaatctcctggtgtcaggagatcttgcaactgagaactgagtgccccttccacctcactcataattgacaggggccagtgccttgtgtgggcctcacctcacctggcatcaccactcctcacccaaccttacctcaccttaccccaccttaccccaccatacctcacctcaccttctctcctgctcttgagagacaactaggtaactgtgagtagcacttctcccttggcatagtgaagcagcttcctcactgatgctcaattcaaggaaagagaaaagttcttgtcttgagttaccatggggcgggggggaaggggaattttttttaaaaaactactttgagcttcacacttaagatttttacaaaaatcaattatatttggtttctcttttgatcatgaaggtggtatagtttaagggttgaggcatggatactactggaatcagacactagtggactagaattttggttctatcacttgctagctgtttgaacttggggaagtttcttaatttctttgaacctcagtttacttgtctgtaaaatggggataataatgcttgccttgcatggttgttgtaaagattagagagtgtctgtacagcatgattcctgggacccagtaaggactcaataaaaggtagttgttattattaaagcaggtcatttatgtttgtaacaaccacagggttaagctcattgtcccaatatccttttatctcatccctcagcatgcttgcttttgccttcctgaagctgaagatatttatcctcagggcaagagacattgggtgtgagggatttaaggagacagattttcttgacagagggattcttaggtcaagatgagtaaggaaaactcgagagctggatgagtaaggaaaactcgagagcggcctttgccaaggaaatctaaagcaattgccaccctgttggagaggtttctgtcctgtctgaaggtaggaatgggggatagatggatgaatggatgacagccttctgctagccttttgaagagtacattcccaggaaaatagcctctactttctgcagtgtgggagtgagggcgggggatggatattgtttttgagtgaaggaaaccttgtgttccatacttaagcatcatgttcccccaccctgggatgctctgttggcctgatttaaggaaagctttccagttgatcttttaatcttcagaaataacaccagaaatcagttatgccatcactttccttataaaactaactagctttcatttagcagattttgttctagggattcagtgtgtctggatattgaatttttgtactgccggggcaaggttttctgagagtggtatgtttgatgtgtgtggataaggggttgggggtggctcagagggtgagggtgtggagcattgtcttcaaaatccctgagcaaggctgagggtgtttccatgtctactgccctaatgaggattctagcgaataggggcagtgctggctcattcatagatattaaaataaaatgttaagtgggcttccttctaagagtcaactctaaggcattctctccaaatttacttgtctctgttgctatctcttttgttagaatgagaagatactcttgaaaaactgtttatgatacaaatctatatgttaaatcctacttttagtgcagagaggcagcttgcaaaaagtacattccacggagagccttttagacaaactcctttggtaatgtgaattgtagcctttgaatttcttggttgttaaatcttgatttttatgtataggtttgcttcaagcagtttacctattttttacattttagtagaacgactgggtatgttccttttataaaatactcagggaaatggaaccagtgtcatggtctcccttgatctaagttcccagagacttaagacctcagagctgtagcagcaactcagcgagttccatcagcataccggttcccagcagcttttctttatctgtattttaaggagttgtatacagagtcacttttcatgatgacaagatgcagggtaatatgatttgaaaaaagaactgaatgaatcttttttttcccctctgtattttaatggaggcaaactgaatgaattctttccttagtctcttctgctggtctttgccttggttgaaacctccttttccctttgctcagccaccctctggggttacctgctgcttgggctgaagtcctaaggcttagcgacaagtaaccatgtcatgttgcctctgaggctagtgggcacagctgaacactaatatttgggccctaactttcagcttgatttgaagaaatgccactgctaaatgtcatctttttttgtggatccctatttgactgactctttggataaaacaggtgggcaggcaacaaattaagtgggaaatgtttctgtgaaacaaatccgtttaatagtgttacctcataaataagtaacaaacacaactctaccccctaacccgcactagcccatatagccagaatggaaaagtagattgtttctttgtcgcttctgttatggttttacttaaatgaattatcagatcagacccctgtttgtacagaagtttcaaaaatgtttgttgtaaattgatctgagccaatttgattttccacagttaattagattctattctggtaggtatcattaatctccaatagtcagaggtaggtaagtgctataggtttttcccccacaaccagtagattacagtgaaaggaattctgattaaattctgccacgtaactttattaataatcaggcacaagacagttatacagcctgacctgtacacccagagacattccagtactttttttgcaaaccaccatactgtgtgaagggttcaccggagatagatgtgacgatattttagcagtaggactcagcttaccttctaattagagggcacatctgagtcctccattaagtgtctggacataagatttgttgggactcctgagcctaaggtgtcattttaaaggggtgaagaatgttgggctaaccagagtcttatatccaattcatgcaaaagtgggagcaactgaatatttctaaatgatatacctgtcctgaacactagccagtttccctaatgaaatatttctagtatccattgttgtaacgaacaaacgatcagaagtacttcagagctgaggcatgtaagtgtgacttttttccccattagaaaaaagttaaggtatatttaacatacagtaaaattcacccttctaatggtacagttctgtgagttttgacaaatgcatacagttctatgaacactccagtcaagatagagaatatttccaccacccccaaagattccgctgtgccttgattgtgggattttttaagagcagctttactgagatgtaattcatataccataaaattcacctacttaaagtgtgtaattcagtggttttcatatactacatttaaaaaaattagttaaatatatacatataacatacaaaatttgccattttaagcatatttaagtgtacacttcggtagcattaatttcatttgggatgttatgcaaccaccactcctatttctagcacttttttttttttttaaatcacaccaaacagcagctctgtacacattaagcaataacttccaattcttaccttccccaggccctggtaaccactgttctactttctgtctctataaatgtgcctattctaggaacctgttatcggtggaatcatataatatttgtccttttatgtctggcttgttttacttagcaaaatgttttcaaggttgtagcatgtatcagaactttgttccttttttaagggtgagtaatattatattgtatgtatagatcacattttatttatctgtcagtggacatttaggttgtttctaccttttggctattgtgaataatgctgcagtgaatgttagcatacaagtatttgtttgagtccttgttttcagttcttttgggtatgtatatacctaggagtggaattgctgggtcatatggtaattctatgtttagctttttgaggaactgccaaactgttttccacagcaactggccactttacattcccaccagtaatgtacaagggttccaatttctacatatcctcaccagcacttgttattttctatttttaaaattatagccatcctagcagtatgaagtggtatatcattgtggttttgttttgcatttccctgatgactaatgatgttgaagtttatttcatgtgcttattagccatttgtatatcttctttggagaaatgtttgttcaagttctttgcccattttttgaaaaaactgggtttttgttgctgagttgcaggaattcttgattgtaggctttgattagaaatttcagttgctaactaatatcacccctggagtttgtattctcaattaggggtcttcagatgttaacaatggtgtgtggtaaatgtttaaagctctgatttatggcatttgccaatttccatggtcaattccaagctaccagtctgacccctcactaaggtagcaaaggagttgggaagagatgtacacaatcaactctttctagccagtgctattgggcttccagcatgcaacagaatgttaactcaccaccctatggtgtagaataaaactaacacagaggcatatttatcacagtgtctacactgaaactatttaaattaaattagacataactaaataattttcaattacaacactttagctccttcaataaaagcaagaataattatttgttgagcacatcatatgctagatgtgctccaagtattaatagatattattagtaaatagaggaggaaatgtagaataagttagtagtaggctgggacttgaagtcagactccaaagcccatgtgtttgatctctttactgcactgtcttctatcccattagtggaatttacttactgaatgttgactactataaacagagtagactactttcttctaaccccagggatgcttctgtgttactttgtaccctccagcctctctaaatcctgttcaaattggaattgaaaactaaagctgtggtggtaccacatatcaaagaactgtaaggggttaaaaatatccttttcctcgttgcaaaaaaagcatgtgttgtaagaaaaatttaagcaagcgagaaatggcaaaaatagaaagtgaaagtcccccataaacccatctgccagagataatcattattaacaactagcatttattctttcagagctttttctttacacattttttttaaaataacaatgggatgattccttataatctgagtctcttttcacttgataatatagttaggctattttccatgccagtgtgtatagctctactttattcattttaacagctttgcttcattcattttaacagctacataatatcccttgtgtgaaggaaatgtaagggattttgaagggctattttgaagaagtgatgataggtggcacatgggacaaaaaggttgaaaactactgttgggtaccaacaatagaggcactatactttccatttctccccccagaggctactataacttacctgaaaccataagacgaaaatccatgagcactgggaagagttacaggaaaactcaaactaagctagtcagggataattgagagataagactacatatcaaattccttcacatgtctttagggctttacagccctggtctttgaaactctatttggaatctttcttaatctccagtaggccctgctttgagtttgggaaacattgttttccaggaaatacaaccttttaatttcccctcatctgttcctcatcttgagagatggccaccatcatgttttcttgctgtgataatctgtcaggttttttttttgttgttgttgttgtttgtttttgagacaaggtcttgttctgtcacccaggctggagtgcagtggcgtgatcatagctcactgcaaccatgaactcctaggctgaagcaatcctcccaccacagcctcctgagtagcggggactgccaccattccttgctttttttttttttttttttttttttttttactttttttctacagatggggtctcactatattgcccaggctattttggaactcctgggctcacatgatcgtcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaactgactgaacgcttgcagagagatgggctaaaggccagtggtatcagtttatcaggatttgtctgccttacactctcttatccttccctctttaccccagggagctggcagaatggtgtttcctctgtaatatgacatatttagattcttttaccagtttaaagaagttaatttaatgggggtaaagggggctaagtttttagggttggggtcaggtactatcctttataagaaagattatgggtgtttgaagctcatgaatggacatgtcattatctttcaaattacatgctaaggatcaggtttgtatcgtatgtattttactatgccttctggtccatatctcagacaaaccactctgtgccagctgtgctaggtgccagcagccatgaactgtgccagagaccctgcctccctggcttaggttgattggactgagtggccacctgtcaccaagacagcccatctgtcacctagcaggtaacatgggcttgacgagctgagagctgggccttttgtattcctctcttaggaaattagaattgggaagctgagagcctaaggcagtttgtaacggaaaagagccaaaagatgatggggagtggagcagtcatgacagttcatgtcctagctagttttttgaagggacagaaaccatgagcaaacagagggaccttgcaagggaggaacagagatgccttgagagacagaagagctgtttcctacagacaccatgaacccagaaccactttccagttctcctgaggcccagctttatcctaccctaggattcaaatgggatacctgtattctttccacaaacctcccttttcttgagccagcttgaatgagactctgttttcccacaatggaaattatcagaccagatctaggctcctacctttacaatcgacttctgggttgagtcaacaacagttggtttacatttaaggctgacatgaagtgctgaagactattctaggtattacggggaacagtggaaaaacacagatacctgattatttctgtcaagctcagtgctgacgttatgggctttgaatccgtgttcctggcaaacagtgagaatgaaaagaggcagggatcctgactgttcatttatcacttcacagctctcaaccaacagggggccttctttatcctatttaacctctcagtagagtatttgccttttgcttattcctctttccagtcaactcttgattattcatgtaatagaggaaagcattaatgtgaatgatagaagactgccccaccttggcctctcttctctgccacagcagcatccagtcacagaaatggaaacaactagcaggagaggtaaggaggctgaaaaaaggtgggatggggccaagcaaattaacattgtttcttctacttttataccttctttctgttaataaatgctgcctgtttgagtttctcttctggtgtcactaggagattgctggaacagcaatgccatttgcttgatttaagtcaaaatatgggatcttttaaaaaactaaaatagagttgggggcaattgactaggctgttagtttcctctcccatctattgtacccccttttgtcagtgccacccagctttcttgttggctgagtttaatgttgggccactagcaaccattctttgttcaggatttgggactcagctagccaaaatatccacaatagcatttctcaaagtatggttcttgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagcagctgttttggaattagaacttaggccttctgacttccaggcaatggtattttcttccagaggtatacatttctgtaaataaagtctgaatgcattggaataacttaccctgggggttatttgtagcagtctcaaatcatttgatcagggtcactactggtgatatatagagggaaataggagagtgaagtaatgcagaacataccttctgtaatttagatttggatcatttttgctgggcctggagaggaggagctaggggagtacagcttacccatggcgctgcttacggaatttagacataagagatggctgttcattattctgggattccacatctgtacagagtgtagaacataactgaatactcagtaggtatttcttgattatgcgatttgctaaaatcactctgctagtgtgttaaaaataccatttagagttttctataccatttaccatttaattgataagcatgtggtttgataaatgttgttgttattattgttattagaagtagttttatgtagttcttatagagatataagggcctttagatcatttgatttggggccctgcctcagctattaaaaattgcattgtaccttaaatacctgttgcctaatattgtttgccttctcattgtgactcttgggggtttctgctgctcagaatagaatggaatctttcataagactggattaaagggcatacggcctaatgcagcagtctctaacctttttggcaccagggacaggtattgtgaaagataatttttccatggactgaggtggggggtgggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaataataaaggaaattcattgaacaccgttaagaaaagataatgcatgttttccttcaaaccatcaatgctttgccccgtcactgatttgcttgtgcgacccttcttttatgtcactctgaataaactcccctttgtctttctgggccgagggaaccaaatgactatagagggactcttattggagtcacacatttctttcctccttgtgactgccaaaccaccaaactctgggccatttgcatgtgtcttaatttctcctcataatgtggcaaaacacgttttggtgctaggtacgatacaacccttcctggagtgaaccaaatgtggaaagtgctgtaatttgagggagttttcagaaaagagcctcttctggtacagaaaggccctttttccttttttctttctcttttttcatttatgcctcatcatattttgtccactttcagctcatctcaggctgaattttccctttgatgtctgctttatagaatagcccttgcctgagaaaagagaacaaaaggccaactctgtggctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgttatttaaaaattcatacaattttaaaggaatagaatagcatatatgattccctccaacctctgacccctgatccactagttcttctccccagaaacaaactgccattaccagattcttggaaatcctgagaattactgcatgcataaacaaggcttgaatattctaaaatggcttttgcttaggtaaccaagtctatccatattgtatggagacatcttgtttcatttattcattcagcaagtacctgatgagcatctcatatgttccaggcactgtgttaagttctggacctacagtgaggaccatcacacagctcctgctctccagaagcttatggtcagcagggaagatcaacatttaatgaaaacatagctaaatataaatgagaaatggtgatatgtgttgtgaaggaaaagaacagcatttacatgcatctgtttttttttttttttttttttttgagacggagtcttgctctgtcgcataggctggagtgcagtggcgccatcttggctgactgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttcccttctcttccagcttatgtcctgggctgggctctggacagggagcagaggcagatgtgcgcatgtgttctggaggacttttatatgtccgatggtgtgttaggcactatgtggagtggaggcagagggaactccagaaaagataaattatcttatggtggagacaaaaggtagtattggcaacaaacatgacctctggaatcagatagttttgggttccaggcctgactctttgactcacttattagttgtgcgaccttaggcaatttatttaacctttctgtagctcagtttccttgtatgcaaacaggaggaaaataataatctcttacataataggattgctatgaagaatatatgaactaatatgtgtaagacattgactgtagtgccaggcacctagtaagcactcagtaaggaataactactgccattattgttgttactaacaacagtatgagactaataagtgattagtgtataagtaccaacaaataccaatggagttcagaaaaagaatgcttaatttttgtgacttatccaggaaatctctagaggagacagaagaagtggaatgaaatattccaggtggagcaaatatgaaagtgggaggctgaactgaactggagtggggaacaaaaagaagaaacaaacgcaacatctggcacccttgagctctaccaccagctcacctgttgtcactaccaatatgtccagtcctttatggctctccattttggagtgccctgaattactggctgcagttttgacttggccagctagttggccagctgctctgactgagcttgagggtgtctgtgccttggtggagttgacacgggtcctaactctgcaacttggtttgtaggttcaaagcctaatttttatcagcttacccagggctgttggtttctagtggattgggtcacactccccaacattacaaaacacttcttaataaatcaccaggctgataagtcgattgatgatgagagagagacctttatagagatgagaacacttgtgtgtatcagccctttctgatatcaaggtacctgaagccaaattaaacagggactgttttataacctaaaatcagaacctaatggagttgaaaagtctcatgagcgagaccatataggctttggtagtccatggaaaactgtacctttttgcatgtctgtcatagctttgtagtgtgaccagaatgtgtgtcctgttctctctccactgctggagaaacatcagtaacaatttttctcttggatgttcctgttttcaattccatgcaaatgctgtttgtgtgctatggccatgctattctcttgaatttcttttttcttgacaagatttttgagttgcctacttctcagcgacaacatagtgattctctcattgagtgttctttttggctttgttctcaaacactaggaatgtttccaagcagggccgccacgaatggctatgcactgcacaaccctaggagagggtgccattcacatagactataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtggatttgatttgcatttccctgatgactaatgatgttgaacatcttttcatgtgcatgttgagtacccgtgtgttttctttggagagatgtctgttcaaggttatttatctttttattgttgagtttttttaatactttagctatttttaatgtatatatttaaggttttcaacttaatgattatatatatatatggaaatcaccacaatcaagataacacatgcattacatcatagagttatcatttatgtgtgtatgcgtgtgtgtgtgtgttggaaatacttaggatctattcttatagcaaattttaagtatacagtacagtattttcacctatagtcgccatgctgtacattagatatccaggacttacttgtcctggaaaactaaaactttgtactttttgactaacatcttactttcccagcaccagccccagctaaccatcattttatactcagcttctatgagttagactaatttacatttcatatttatgtgacatcataagatatttttctttctggctcatttcacttaacataatgtcctttgggtccttctgtgttactgcaaatgataggatatccttctttttaaaggctggataatataccacattttctttattcatgcatccatcgatgaacatttatcttgtttctatatctttgctattgtgaataacggtgcaaggaatataggagtgcagatatccctttgagatcttgatttcaactgttggataagtattccagaagtgggattgctgtgtcatagaataggtctttttttttttttttttttgaaactatactatttttgataatggctctattgatctccatcagcagttttccagggttctgttttctccacacccttcccaatattgccatcttttgcattttttataatagccattctgacaagggtgacatgagatctcactgtggttttcatttgcatatccccaatgattagtgatgttgagcaccttttcatatacctgttgtccatttgtatgccttctttggaaaaatgtctattcagatcctttgcccattttaaaattgggttatttgtatttctgctattgagtttatgagttctttacatattttaaatattgacatcaaatttgtggtttgcaaatatttgctatatagctttttaggttgatgtagtcctaattgtttttgtttgtttgttttttacttttcttgcacgtgcttttgatgtcatattcaaaaaatcattgccaagaccaatttcaagaagtttttcctatgttttcttctaggagttttatggtttcagatgttacatttaagtcttaagcccattttgagttggtttttgtgtgtggtgtaagataagagtctgatttcattactttgcgtgtggatatccagttaccccaacatcatttgttcaagcaagcatcttttcccccattgtgtatttttgaccctctaaggttctttattccttttcatccttttttttctttttctcttctgatgaggtaattttaaataactgttcttcaaatttgctggttctttcttctgcttgataaatctcctgtttttagttgagtcattgtattcctcagctccagaatttgtttggctgttgtttacagtttctatctttttatttaacttttcattttgatcatacattgttttcctgatttcattgagttgtccatctgttaattttcttttttattgttgagtcttaagagctatttattctgaatactagactcctattagatacatgatttgcagattttttctcccattctttgggtcccctcccctcccctcccctttctttcttttttttttttttgagacagagtctcactctgatgcccaggctggagtgtgcagtggtgtgatctcagctcactgcaacctctgcctccctggttcaagcacttctcctgcctcagcaggagaagtaatcccaagtagctgggattacaggcatgtgatgtgccacaacgcctggctaattttttttttttttaatttttagtagagacagagttttgctgtgtgggccaggctggtctcaaactcctgacctcaagtgatctgcctgcctcggcctcccaaagtgctgggattacaggtgtgagccaccatgctcagtctgggatgtcttttcactttcttaatagtgtcatttgaagcatgaaatattttaattttggtgaagtacagtatatttattttttcttttgttgcttgtgcttttggttacatcttagagtctgttaccaaatcctaggtcatgacatgtatccctatgctttcttttacaagttttatagtttttgctcttacagttaggtctttgattttgagtgaatttttgtatatgggttatgaggtaggggtccaacttaattcttttgcctgtggataaccagttgtcccagcatcatttgttgaagagactgttctttctaccattggatggtcttgataccttagtcaaaaatcacttctgaggatttatttcagtactctcaattctattctgttggtctctgtgtctttccttaggttagtaccacactgtctttgttactgttgctttgccataagttgaaatcaggctgtgtaagtcctcccactttttcttttcaaggttggtttggctgtttggggtcccttgcatttccatatgaattttaaaatcagcgtgtcagtttctacaaaaaaaaatgtcagctgggattctgatacgtactgtgatgaatctgtcatttaaaactttcaaggaggagtgtaacaggatcagaatgctattttaagaataggaacctgacaatactatataaaattagagcaagcttgtccagcctgtggactgcatgtagcccaagacagctttgaatgcagcccaacacaaattcataaattttcttaaaacattatgagatttttttgcaattattttaaaaagatcatcagctatcattagtgttagtgtattttatgtgtagaccgagacaattcttcttccagtgtggctcagggaagccaaaagattggacacccgtgaattagagtgatgaaggaaaaacactggatacttggagatcagataggaaactgctgtagtagtttaagaaaatgatagggaccaaactaggaaaagatagtgagggtggatttcagatgtattgaaaaggttgggctgggtgcagtggctcacactagtaatcttagtgctttgggaggctgaggtgggaggatcacttgaagccaggagcttgagaccaatctgggtaacaaaatgagaccccatatgtacaaaaaataaaaaataaaaatagctaggtgtggtggcacatgcctgtagtcctaactactcaggaggctgaggtgagaggattgcttgagcctaggagtttgaggctgcagtgagccatgatcacaccaatgcactccagactgggtgacaaaccaagaccctgtctgaaaaaaaaaaaaaaaaaagaaaagaaaaagaaaaggtctaagtgacaagacaggatttggggactgaatacatgtggggctgagaaaggtgggggatcaggggtaactctgaggtgtgaagagaggctaatggattagattatagtaccttttaaaactttgtattattttgaaatgacttttgacttacagaagagttgtaaagatattacagagaattcctgtatatccttcacccagcttcccctaatgttaacattttacataactatggtaaaattattaaaactgaaaaattagcatttatacaatgcaatatgaacttaactacagtctttatttgggttttaccagtttttttcacaaatgtcccttttctgttgcaggatctatttaggatccttaattgcatttagatatgatctctctttagtcttctctaatctgtggtagttccttagtctttgcctttcacaaccttgactattttgaagagtactgttcagtttactctgtagaatgcccctgatttgggtttatctgatgttttttcatgattccattgagattatacaatttgggcatccaataaggacgatgctatcaatagctcatacttattttattccctacagtgtgccaggcatttgaactaggtacctcaagcatttaaattttacagttaccctatgaaataatactattgtaatcctcacttgacagataagggaactgagcctaaagggttaagtattctctgtaggcagctggacaagggaagttgagtaatatgtcagaatgttgttattgcaaacatggaattaaaacaagtgaagttagaggaattgaaaatttaatatgatttgttgctgaattggctcatagtagggatgaattttctattgaaatcaggataattatagctattatgtattgagtgctagctatgtgctaggcattgtgccaaatgcttttcttgctttgtttcattttgtcctctcccaaaccttgtgagacatagatactatttttgtctctattttacagatgaaaattcctctaatctcttgcccaaggccagagtgctggtgagtggcagagccaccatgtggatccaagtttgtcttaactctaaagcctgtattctttaaccacttggcaatgctaactgtcctccttccatcttcttagtagggatgaatttgccaatgggactagaaaacatgatatttatgggcttggatgtagacactgcttggttgtggacattaccaaatacatgtttgcaactctccttattttatacctcagtggttggtcaaccccattctttctttgggtatatttcaagcaggttacaatctggtctttcaagtctgggattttaacgcttaactcttagtaggcactcttatttcccttttattcaaattcttgagggaagcttctttataaactccttagactgacaaaaatagtaaaatctcagaaataggcaaatcaagggagataatgaaatcaccagaatgggcgtttaaccgtggagtgtaagggaagctttcctggagaaaatagtttaattttgcatttgaagggtagataagagccacaagaggaaagttggaaaaaccatctggaagagggaataggattagcaaaggcacaatttcttgatgttagagatttaaatttaaaaaataaaattatgaaaatgttaagaaaacaataggtgactctgtaatcccactgttataaaagattttcaaagcgtgatatcaaagacagaagccataaagggaatgacaaatacatctgattacataaagatttaaaaagcttccataaataaaaacctatcataaacagagctgcaacaatgacagcctgggaaaattttttgcaataaatttcagtctatattagctgtcattaatatataaatagctctttacaactcagttgaaaagaacacaccagctgaaaaacagtcaaagtgcacagatggtcacatcccaaaagaagaaatatggctggccaatatacctgttagaaaatagtttaacatttctggtaatctgaggcatgcaaattgtgtgtgtgtgtgtgttttgcctgttaaacacgtgataattaccaaatgataatgacctgtttgtcaggttgcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagaggttcggtagagaaggtgggaacctggaaccagagaggttcgcaggtagaggatgaactgggataacagctgatgcctagattggatgcttaggaaagaactaaaggttagtacagggatctttcctgaggaagctgagagagtgtgtggttttgaatggaaccgtggattttttctgggaaaaccagccaaaaaagacctcagttttataaggattgcaagtgcccaccagacctggggatgaggcaggtgggagctataatgaacctgtctttgggactctgaaactcatctatgtaaatgcaatttgctgtccagttgagtttgtgttttgagatgtctcacactgtagagagtagatcttatgagctggctgatggcacaggtgtggggctgttggggtgactccctgtgtgccatgtggtcaagggccagggctagagtctaaagaaaaggagctctcatgagccctggtatgtgtcaggtgtgaagtggaaagtgcattgaactgggagttaagggacctgggctctcatcagaaagcttgtcagaaccttttcccctcagtttcctcatctctgaaatggggtttaataacatggttctgcctgcctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccacaaaaaaataaaaataaaaataaaaaataaaaaaattagccagatatggtggtgcacacctgtagtcccagctacttgagaggctgaggtaggagaattgcttcagcccaggagttggagggtacagtgagctatgattgcaccactgcactccagcctggataacagagtgagactttctcaaaaaaaaaaaaaaaaaaaaaaaaagataccttctatgctgctatgctgatgatagaaataggcaagacagaaaagatgaaacgactaaagttagaaccatgactgatggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaa

SEQ ID NO: 4912 - DNA, 174673 bp, human
agttgctagctgggggcagagacggccacgcggttgcaggagtaagagatccctctgtggcgagtgcgtgagacgaggagtccggcgtccctgccatccccgtcgccctccccgcctgctcggccccgctagctcctctccttgcctccgcgtgtcccctagctctgaccccttttggctcccggttcgctgccgcagcactgccgggtctccttggcccccgccctgaccctttcggcctccggcttcccctgacccctgcttgcttcgccactgccccgttcccgttttcttccctcgctagttacccctcccgcttcctaattcccggtgcaattgcctctttgagacctcttttttttttttttcctctccttccttttagattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaagtgataagagtcatttatgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctgaaccctaggaacgactggcactcaccctggctgcccctcccttccagcccagcccaaccctgccgtgccctgggctttcacaagcaggaattccagccccagccaggtgccctttctgaatcacatcagtggaccatgacccagctcccttgccttctgtggtagttaatttcccaggggcctggtgacactctttcctggaggtggtcgcataaactttctcatctacactgtggtactttggggaaatacttttacaggtttctcttaatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataataccttgcatttatctaacaattactgtttataagatactttcatatacattgttacttttagcttaggcctggagaaagggatgttaaaatgtttcctgcaacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttacccgcttttggttcactgtttgattttcttacttcctctctccttgctaaaagtgtagaatgacacacactcagaaagtcctgagctttttgtgaaaccccttgcaactcactgaatacacactgttgcattccggttgttatgtgatgaatttgttttagagaagacctgatggatttgagaaacttggctttctgttttcccccttgacttcacaccagacacacctcctcattctccatctgttgtctggagcactgattatcattcctgcttggaattgaagttggtgggtaatgggtacaataagggatccagccatctgctgacagcttatcagatggactgcgtcctgtgtcatcagtccagggggatacaaggggatgatgtttatatgggcctcactagtgaggcatgacattcctttttagtttgtttctccccccaaggaaatttgcagagaatttttccatctttcattgttacagtcattgggggtgtccatataaagagaggtgctgtggattggtgaattaaacaacccacaggcagccccaggatttaaaattatgatgctagttttgctcatggcttgctacaggaacctcagcaaactatttaaccttttcctatctcagtcttctctgtgaaacgggccacatggaaatgaagcatttgaattctctgaataattatgtggtcacttaaacagagaagctgggcaaagctggtcaaagatggcagatgaccaatacagtttcaacttcagactcagaaaccgacaaagctcaactccttatacctttcttgatagcttctagaaggcattcctctaatcatttttgttacttttctctggatccttgcctgtgtctggatacctttctgatgcatggcatataaaactggacactaactcttaccagaggtccagcctacaccaagcagagaggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcctttgacctcactttgagagatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaatgaagtgtggtgccatctttctacctttctttttcatatctcttcttccctgtttccaagtctgtccacctgatccaccccacacaagttccaaaacaatcctttctataattcaaaatgcccatctcatcagaggagatgatagccatgggggattaggaagaaagcagttttatttcagaggttcatactgaaatgtgagtggacagactccactgggcgtcagggagaggatgagttttaaaaaagggccttgttaccctaacattatatctaattggtagactgtgtctagtgtttttaagcagatgtcctttctcatgtgccttgctcaggttttggcctcttctctcccgctaaagcccctgatcaggagaactggagttatccatgccttgccaccctacatgctgacccccagggtttcatattaatgtaaatctccctccacagtgcttggatgcagcagttaatctgaaggcctggcgaggacccctcttctgggcaccagtcagtcctctgtgtttactcagctctttcctggctacacagggcagcgcttgcacatctgtcagttcatgggcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctccttttcaagactttgctctggggcctcgttttcaagactgaggtctggggcctaagccaccaatcactagagaaggatccccttaagagcagccttctggggcctagaccttgatcatgtgatttcaggccttgggatgtggggggtgtgctgtatcctgccaaggccattggaaggcctctgggcatattcccaagcattgtgggtaagaaggctgtttcttagtcttggaggtgggagaattgagaaagctaaggtcatgttttctataacctggttcctggaagaggagctggtttagagggcatttctaaacaaacagcaacccaaataaacagcagcgcttggaaattagttatgaaagttcacacattctaagacctagggaagattgtaacaaagggtcctcttcatatcagcacttgttcattgttggtttgcatttgttaagagtttccttttttaagttccaggaacttgagtgtgtgtgtgtgtgtgtgtgtgtgtgtgtgcgcgcctgtcactttattctctgcaccctgcaggaatgttgctcagagtcatgtgcacaagtgcctcattatcagcagcgctttcacacttggtcccttgggctgccactgctactggctgctgcttcatgtgggtatttctacctatttcctggagccccagccccacagggaatgttggcaccctgaggaaagggaccgcctctacatttggatctcccttctgctgcagggcagctgactttactctgctttcaagttcacctttcctcagaatagccctgcaagctagcaccaagccaaggttatgtttccttgcttgcatgtggggtttctggccagtcagccaagtgaactgattgacccccagccctgtggggaatttcaggggggtattgtcttggtcatcggagtcaggggtggcctttaggccaaggctgcattagctttgtggagaagaatgtgaagcccgccgtgtcacagggtctgctgaccggctgggtagtgtttggccatatctcacagccagtgctgtgtttgctcagatggacgcacatggaaaccaggctaggatcatcttcccaaatgtcttactccctgctttgggtctgtcctgaaaaacaatttgcaaagtacattgtggtctgcacctgttgttttttcatcccccttttccacagtcagtttgcagtgaatggaggattaatcctggctcttgccacttgtattttctctttcccttctttccttgacgttgggttcttgcttttcagttataactgtctgtggacattaaggacagctggtgcccctgatcatttaggacctcccttaggcctttaaaacgctggaaatgtgtaacagggccggatgggcaaaaaagagtcgaatttaggagaaaactcactataatttctggttatctttgtacactctcagaaaagtgaggagtggtagtaataacacttgtaacatttttgaatacacgttaattatgctttaggcatggtgcttagtctactgcctgtgtattacctcatttgcagccttccagaaaggttgttttttgtttcatgtaattttttgtttttttgaaacaacgtcttgctctgttgctcaggctggagtgtagtggtatgaatatggctcactgcagccttgaccccttgggctcaagcgatcctcttgactcagcctcccaagtagctggaaccacaggcacgcatcaccacgcccagctaatgtttttgttttttgtagagatggggtcttgccatgttgcttaggctggtcttgaattcctgggctcaagcgattcttctgcatcagcctcccaaagtgctgggattataggagtgagccaccacacctggcctgttttatctaattcttcttttctttgcttctagctgatttcccctttggtagactataggcactggatgttctagctgtactttctcaggttgttaaaatggcagagtgataccaaatcagagctgaaagaaacctctgagaacaactaatttgtttctttttcatcccttgttttccagatgagcaaactgagacccagagaggtgaagtgatttgcccaaagtcacacagctaaatagaagcagagctgagtctcctgactcccatttcaatatctctctataataccacacatggcctccttctatccttaaccttccagcatgaaaggaactagacttttcttcttgctcactattagagaaatggaaatcttgtgctttttgagcatcattgtttattgccttcttgaaagtgaggatctcctggctgcaggccacctccttcctttctttctttctttctttctttctttctttctttctttctctctctctctctctctttctttccttccctccctccctccctccctccctccctccctccctccctccttccttccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactctatctactactcgaccctttacactactgccagaatgatacaagtaaaatacatgttggatcatgccattcccttcctccaaaacctttgataactccttaatgccttcatcagggatggtaaacacatagatgcatacactttatattgtccctggccgactgtgctaatcaatcataggcacgctttcccagggagagtccaagtagatttaaaatctgtttagcatagcattctaggtagccacttatcaatcagtcagagctggtattaatatatagactagggatggcacatagataaagcctgtagagaaatcttaatctccttatgataggattcggtatcttctgtgattttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgtgtgtgtgtgtgtgtgtattgagtgatatctcaatatagttatttcctcctctttattcccaaagccttgggagtggactgcttgtaaagtgttggtcccatagcctgctagttagttgtttacttgtcaagagagatctaagatgtaagattctcaataatagtaactacctttattgggccttttcagggataggttttcagacttactctgaatcatacagcttgtaggatgggtgccagcactaggacccatatctgccccttttgagcagagtgcctggcatataggtatttgatcattgtcacatgatgtgacaaggagctttgtttctttgtgcaatgcttctttttattaaaaaacccagcggtggtaaaatctgacgtatttgaaaagtctggtgggagagaggtttgaggagaactgcctggcattcaaaaagcttatgatatgttagatagtgtgtggtgaatctagatcacataacatgtattaagcaattactccaggcctagtcgtactagagagatacaaaagtattagatgtggtttctgcccccagggaacttattatcaaggctcattaacagtctgactactgtattttcaggtggcaagtatgtacagaatttatgaccagaaaatgctagagatcagagaggctttcaagttcctgaagttcaagcccgtcgttttgcagatagagaaagaagcccagagcagaaagctgcttgctgaaggtcacaccacttgggaatggcagagccagggctggtgtatatggccttaccctttgaggtcctattacactctgttctgtcgcccttgaaggacaggtgaacctaatggcctgtgttaaaactttaacgatatgctttatgcctccaggcctccttatggtttgggggaggggaggttaaattttagtctttcttaaaaccttgagtgggaagggccagcactggttacctctggctcaagcccaagagttctaaagatggctaattttccctttactgagacaaccactgattctagtctaattagggcactttcctactcctcctaagggtctttcccaagctcagtgtgtttatgacttttctacttcagttcctcatttttttttttcctttttgtgaaactcaccttaaagacaagaggtgcctgtccttatgggtgggcctgagagttagaggagtggggccagttcctagtgatactagcatcaggctggttcttttggccttgtcccctgctacttcccaagccagaaatttagatccaagtttggggctttctcagaaggttcaggtataattcaaggtagaggtattcttccttccagacccctctccccacacagttagtattagggtataattctagtcaccactaacatctattgaacgcttaccaagtgccaggcatcctgtggaatagatgctattatttgcattcccattttatagataagaaaaataagggtcagggaggttacgtaacatacccaaggtcacacagctagaaagtgaccaagctggtatggatgtgtagatctggctgactcgttactgttaggctaatggagcctaacatgaaaataagttactaattatatttttgtattgacgaagaaccatttgccaattttctgcaagccaatttaaagaactggttgaaagagaagcatcctacctatagttctgttccactgtggggtggactgtatcaagaggcttgccagtcacctgcatttgtcaagtaagtcccttcccttctctgagattcagtttctgcctctgtaaatgagagggtcagaccagatggtatctaagaccttttctggcttcatttgctacttcctggtagaatggaaaaattgtagaattggatgaaggacacaatgcattagaaacacaaatgtggagagaatacatagttcatcacggatgggttagttagccagttacacactgtttctgttttcccttgtgaatttataatgaaacattttttttttcttttcagtgagcttcttgctaacatcagaaagtactagctttccttttttgttgtttggttcttttgtttgttggagacagggtcttgttctatcactcaggctagatgcagtggtgtaattacagctcaactgtaacctcgaactcttggactcaagagttcttccacctcagcctctcgagtaactaggaccacaggcacatgccatcgcacctggctgatttttaaattttttgtagagacagggtctcactgtgttgcccaggctggtctcgaacttctagcctcacgtgatcctcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttttgtttgtttgtttttgtttttaatgttgctcagtcatgccacgaaatgggtacctcctaaacactaacttggataccctgctggtttgctgcctttcagttttctattcacataattattgtttgcattcccattctaattttggcctctggtctcagtaagaaggagaattgaaatactcagtgtcacactcattacacccacgaccctcattcatttcacaaactaacctcctgtatttcttctcttcttctggcttggcatagggcttttgacttagatctgagctcaaagctaatttctattactcatgagctgtgtgcctttaggcaagtcacccaatcactgtcattatgtttttcatttgtaaaatggagctaaaaattctatctacctcttcaagttatttagagaattatgtgagttaatatttctaaagctctgggaacactgtgtggtacatattaggtattcaaaaaatattagttacagtcttcctccttgctccccaagaaatagagccagtaacaacaacctttcttctaatacctcatgaacttctcctggcattagctgtctgaaggggctgaggtttgccttttcttttgacgatggagattagtcattagaaactctggatttcatcctcacaggaaacttgaagttgttgacttttgttccttgttaaagagttggtacgactggggcggaaatctccagagaaaagggcgtgttcctctactaattactctgtagacggcagagggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcaccttgatcatgatatattatcttttttattgttcctggatatggtttgctagtattttacatggtattcttaaacactgtgagtgggctgggcgcagtggctcacatgcctgtaatcctagcactttgggaggccaaggcgggtggatcacctgaggtcaggagttcgagaccagcctgaccaatatggtgaaaccccatctctactaaaaatacaaaaattagctgggcgtggtggtgtgtacctgtagtcctagctactcgggaggctgagacaggagaattgcttgaatccgggaggtggagattgcagtgagccgaggtcatgccactgcactccagcctgggcgacagagcaagactccgtctcaaaaaaaataaaaataaaaataaataaataaataaaataaaataaatctgtgagtgaatctggctctagttttcacttttcatactgcctttgtcaggttttcttattaagtttgtgctagcttcataaaatggattggccaatgctgcttcctcttcttctaagctttggaaaagtttgcatgagatcagagtgatttgtttcttaaaggtttgttagaacttgcctataaaactatctgggctttgatattgtctttgtgggaagattatggactactgattcaatttctttaatggttataggaattttcagacattgtatttttctttagtcagtgtctttaatttatgttttgctaggaatttgaccattttgtctaaattttcaaatttattggtttaaaattgttaatagcgtcttaactataaacactacagatatttaaaagatttcttccttttctctcatactattatttgctactaaaaaatcaatctcactagtagtttgtaagttttatttatcttttataggaaataattgagactttgttgatggaactgttacatgtttgttttctattttgttaattgctgcttattttaaaaatctgttttctccttcatattttctttggagttatgtctcttgttcttttcctaacttaggtgggatgcttagcttatttatttttagactttcttatttgactatatgaattaaaaggttaataatttttgctacctactgtttagctacattccactaattttgatataacattttgttattgctcagttccaagtattttggaatttccattgtgctttcttaactcatgggttgtttagaaggattaacagttttttcctaaatgttttaaaagtcatctttttgttgctgatttctaacttaataacattgtgatcagagaatgtgatctgtatgttctgtttctttgaattttgttgagatttgttttgtggcccagtatgatacagtgtccactagatcaaccttgttaattttgctgctcttcaatcaccttaccttattttttctctgcttaatctatcagttactgggagattttttaaagtttaccaccacagaggtagatttgtctatttcttcttttagtactgttaacctttactttatatatttttgaggttgtgttattaggtatagtatgttaatttttgcatttattgttacatctattgatcaaaatgttcaatataggggtcccgtggcaacttagagtgtggatagatctacatgctataagggtggcttggtaatggtgaaagcatccctctgggtgggctgggtaaattggattttcagctccagggaagaaacacccttaaaatcaaaattgcaccttcttgaagagttcttaaatttgacattgccaaacaaaattaacaccctcatatcctcaagtgccagaggcttttgtcgttattgaaaacactcttaaaagctgcattccttctgggatgcatgaggggttgggaaggaaagctttatttttcatgggccttacagacattacttctggttggtcagacatgtttcagacccttggactttcttcttcttactgcctagtattttctatgagacttgagccaaatcctgttacctctctgccttttaggttcaatgactggttcccttttcccctgacagaagtgaggtgtggagaaattgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgccatttaaaagatagtacattcactgggtgcagtggctcacacctgtaatcccagcacttttggaggccgaggcgggcagatcacaggattttgagactagcctgaccaaaatggcgaaaccccatctctactaaaaatacaaaaattagccaggtgtggtggtgggcgcctgtaatcccagatactagggaggctgaggcagtagaattgcttgaacccaggggacggaggttgcagtgagctgagatcgcgccactgcactccagcctgggcgacagagcaagactctgtctcaaaaaaaaaaaaaaagaaaaagaaaaaagaaaaggtagtacattcttttcaaaaggaactattatgatacattgtgtcttataatttttaaaaattttaaaattttttattatactttcagttctgggatacatgtgcagaacgtgtaggtttgttacataggtatacatgtgccatggtggtttgctgcacccatcaaccctttgtctacattaagtatttctcctaatgttatccctcctcttcccctgcaactgccgacaggccccggcatgtgatgttcccttccctgtgcccatatgttctcattgtttgactcccacttatgagtgagaacatgaggtgttcggttttctgttcctatgttaatttgctgagaatgatggtttccagcttcatccatgtccctgtaaaggacattaactgattgttttttatggctgcatagtattccatggtgtatatgtgccacattttctttatccagtctatcattgatgggcatttgggttttaacattttttaaagagttgaggtctcactctatcactcaggcttgagtgcagcagcacgatcagggctcactgcagcctcaaactctggtgctcaagctatctacccacttcagctttccaagtagctgggactacagatgcacaccactatgtccagctaatgttttatatattttttaagagatgggggtctcactatgttgcccaggctggtctcaaactcctggccttaagtgatcctcctgcctcaacctcccaaagtgctagaattacaggcatgagctgcagtgcccttccctagtcctcctttttataataattttaaaaaggtttttttgcttattgttattatttttaattaatccataatattttatatatttttgaagtacagtgtgagattttgatacacgtatccattaaccaatgtctccctaatccctcctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttctaccctcctcggaaacttctagtgctctcagttacttacaaaataaaatccagaattggtgagctgttccttaaggctcttcatgatgtggaaatagacctcttagaaaaaggttgcaaaagcaatgcatactcattatagaaaatttggaaactaaagaatttggcaaactttttctgtaaagggccagatagtaaatgttttaggctttgtgaaccatgctgtgtctgccacaactactcaactctgctattgaagcacaaaagcagctacagataatgccagtatgtgagtgaatgtgtgtggcagtgttctactaaaactatatacaaatcagtcagtgggccacgtttggttcgcgggttattgtttgctgaacactgctatagaaaataaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctcaatcctatctgtattcatgtacctgtctgtggagtcctccctagttcctcctactcgatatgatctcttgcctttgaatccctgtagcactgtgtacctctcttgtggtatttatgtctttctgcccctttttttggttatctctgtactggctttatgcctatggcatggacactgggtaatgttatctttgcattgactcccagagcctagtagagagcttagtgtacaatgggctgattagcctatcagagctatgttgaaaggtgcctaaggtctgctgcagatgacctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaagctgggtatgtatagtgacccacagtaacattgacattgtagttttctggaattttggagaggcagtctagaccctggtagagccgtagagagagagagagagaggggaagccataagtttggttcaaaatggaaactgattccagcgggaggtgtatgttgtgagaaaagggagatgatgccagattggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacaggcgtgagccaccgcgcccggcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcctcccttttgggaaaacatgctccatttaaatcatacgtagtaagtcttcagaaaccctgaccctggaggggctttgggacacaactgacaattaaatctcctggtgtcaggagatcttgcaactgagaactgagtgccccttccacctcactcataattgacaggggccagtgccttgtgtgggcctcacctcacctggcatcaccactcctcacccaaccttacctcaccttaccccaccttaccccaccatacctcacctcaccttctctcctgctcttgagagacaactaggtaactgtgagtagcacttctcccttggcatagtgaagcagcttcctcactgatgctcaattcaaggaaagagaaaagttcttgtcttgagttaccatggggcgggggggaaggggaattttttttaaaaaactactttgagcttcacacttaagatttttacaaaaatcaattatatttggtttctcttttgatcatgaaggtggtatagtttaagggttgaggcatggatactactggaatcagacactagtggactagaattttggttctatcacttgctagctgtttgaacttggggaagtttcttaatttctttgaacctcagtttacttgtctgtaaaatggggataataatgcttgccttgcatggttgttgtaaagattagagagtgtctgtacagcatgattcctgggacccagtaaggactcaataaaaggtagttgttattattaaagcaggtcatttatgtttgtaacaaccacagggttaagctcattgtcccaatatccttttatctcatccctcagcatgcttgcttttgccttcctgaagctgaagatatttatcctcagggcaagagacattgggtgtgagggatttaaggagacagattttcttgacagagggattcttaggtcaagatgagtaaggaaaactcgagagctggatgagtaaggaaaactcgagagcggcctttgccaaggaaatctaaagcaattgccaccctgttggagaggtttctgtcctgtctgaaggtaggaatgggggatagatggatgaatggatgacagccttctgctagccttttgaagagtacattcccaggaaaatagcctctactttctgcagtgtgggagtgagggcgggggatggatattgtttttgagtgaaggaaaccttgtgttccatacttaagcatcatgttcccccaccctgggatgctctgttggcctgatttaaggaaagctttccagttgatcttttaatcttcagaaataacaccagaaatcagttatgccatcactttccttataaaactaactagctttcatttagcagattttgttctagggattcagtgtgtctggatattgaatttttgtactgccggggcaaggttttctgagagtggtatgtttgatgtgtgtggataaggggttgggggtggctcagagggtgagggtgtggagcattgtcttcaaaatccctgagcaaggctgagggtgtttccatgtctactgccctaatgaggattctagcgaataggggcagtgctggctcattcatagatattaaaataaaatgttaagtgggcttccttctaagagtcaactctaaggcattctctccaaatttacttgtctctgttgctatctcttttgttagaatgagaagatactcttgaaaaactgtttatgatacaaatctatatgttaaatcctacttttagtgcagagaggcagcttgcaaaaagtacattccacggagagccttttagacaaactcctttggtaatgtgaattgtagcctttgaatttcttggttgttaaatcttgatttttatgtataggtttgcttcaagcagtttacctattttttacattttagtagaacgactgggtatgttccttttataaaatactcagggaaatggaaccagtgtcatggtctcccttgatctaagttcccagagacttaagacctcagagctgtagcagcaactcagcgagttccatcagcataccggttcccagcagcttttctttatctgtattttaaggagttgtatacagagtcacttttcatgatgacaagatgcagggtaatatgatttgaaaaaagaactgaatgaatcttttttttcccctctgtattttaatggaggcaaactgaatgaattctttccttagtctcttctgctggtctttgccttggttgaaacctccttttccctttgctcagccaccctctggggttacctgctgcttgggctgaagtcctaaggcttagcgacaagtaaccatgtcatgttgcctctgaggctagtgggcacagctgaacactaatatttgggccctaactttcagcttgatttgaagaaatgccactgctaaatgtcatctttttttgtggatccctatttgactgactctttggataaaacaggtgggcaggcaacaaattaagtgggaaatgtttctgtgaaacaaatccgtttaatagtgttacctcataaataagtaacaaacacaactctaccccctaacccgcactagcccatatagccagaatggaaaagtagattgtttctttgtcgcttctgttatggttttacttaaatgaattatcagatcagacccctgtttgtacagaagtttcaaaaatgtttgttgtaaattgatctgagccaatttgattttccacagttaattagattctattctggtaggtatcattaatctccaatagtcagaggtaggtaagtgctataggtttttcccccacaaccagtagattacagtgaaaggaattctgattaaattctgccacgtaactttattaataatcaggcacaagacagttatacagcctgacctgtacacccagagacattccagtactttttttgcaaaccaccatactgtgtgaagggttcaccggagatagatgtgacgatattttagcagtaggactcagcttaccttctaattagagggcacatctgagtcctccattaagtgtctggacataagatttgttgggactcctgagcctaaggtgtcattttaaaggggtgaagaatgttgggctaaccagagtcttatatccaattcatgcaaaagtgggagcaactgaatatttctaaatgatatacctgtcctgaacactagccagtttccctaatgaaatatttctagtatccattgttgtaacgaacaaacgatcagaagtacttcagagctgaggcatgtaagtgtgacttttttccccattagaaaaaagttaaggtatatttaacatacagtaaaattcacccttctaatggtacagttctgtgagttttgacaaatgcatacagttctatgaacactccagtcaagatagagaatatttccaccacccccaaagattccgctgtgccttgattgtgggattttttaagagcagctttactgagatgtaattcatataccataaaattcacctacttaaagtgtgtaattcagtggttttcatatactacatttaaaaaaattagttaaatatatacatataacatacaaaatttgccattttaagcatatttaagtgtacacttcggtagcattaatttcatttgggatgttatgcaaccaccactcctatttctagcacttttttttttttttaaatcacaccaaacagcagctctgtacacattaagcaataacttccaattcttaccttccccaggccctggtaaccactgttctactttctgtctctataaatgtgcctattctaggaacctgttatcggtggaatcatataatatttgtccttttatgtctggcttgttttacttagcaaaatgttttcaaggttgtagcatgtatcagaactttgttccttttttaagggtgagtaatattatattgtatgtatagatcacattttatttatctgtcagtggacatttaggttgtttctaccttttggctattgtgaataatgctgcagtgaatgttagcatacaagtatttgtttgagtccttgttttcagttcttttgggtatgtatatacctaggagtggaattgctgggtcatatggtaattctatgtttagctttttgaggaactgccaaactgttttccacagcaactggccactttacattcccaccagtaatgtacaagggttccaatttctacatatcctcaccagcacttgttattttctatttttaaaattatagccatcctagcagtatgaagtggtatatcattgtggttttgttttgcatttccctgatgactaatgatgttgaagtttatttcatgtgcttattagccatttgtatatcttctttggagaaatgtttgttcaagttctttgcccattttttgaaaaaactgggtttttgttgctgagttgcaggaattcttgattgtaggctttgattagaaatttcagttgctaactaatatcacccctggagtttgtattctcaattaggggtcttcagatgttaacaatggtgtgtggtaaatgtttaaagctctgatttatggcatttgccaatttccatggtcaattccaagctaccagtctgacccctcactaaggtagcaaaggagttgggaagagatgtacacaatcaactctttctagccagtgctattgggcttccagcatgcaacagaatgttaactcaccaccctatggtgtagaataaaactaacacagaggcatatttatcacagtgtctacactgaaactatttaaattaaattagacataactaaataattttcaattacaacactttagctccttcaataaaagcaagaataattatttgttgagcacatcatatgctagatgtgctccaagtattaatagatattattagtaaatagaggaggaaatgtagaataagttagtagtaggctgggacttgaagtcagactccaaagcccatgtgtttgatctctttactgcactgtcttctatcccattagtggaatttacttactgaatgttgactactataaacagagtagactactttcttctaaccccagggatgcttctgtgttactttgtaccctccagcctctctaaatcctgttcaaattggaattgaaaactaaagctgtggtggtaccacatatcaaagaactgtaaggggttaaaaatatccttttcctcgttgcaaaaaaagcatgtgttgtaagaaaaatttaagcaagcgagaaatggcaaaaatagaaagtgaaagtcccccataaacccatctgccagagataatcattattaacaactagcatttattctttcagagctttttctttacacattttttttaaaataacaatgggatgattccttataatctgagtctcttttcacttgataatatagttaggctattttccatgccagtgtgtatagctctactttattcattttaacagctttgcttcattcattttaacagctacataatatcccttgtgtgaaggaaatgtaagggattttgaagggctattttgaagaagtgatgataggtggcacatgggacaaaaaggttgaaaactactgttgggtaccaacaatagaggcactatactttccatttctccccccagaggctactataacttacctgaaaccataagacgaaaatccatgagcactgggaagagttacaggaaaactcaaactaagctagtcagggataattgagagataagactacatatcaaattccttcacatgtctttagggctttacagccctggtctttgaaactctatttggaatctttcttaatctccagtaggccctgctttgagtttgggaaacattgttttccaggaaatacaaccttttaatttcccctcatctgttcctcatcttgagagatggccaccatcatgttttcttgctgtgataatctgtcaggttttttttttgttgttgttgttgtttgtttttgagacaaggtcttgttctgtcacccaggctggagtgcagtggcgtgatcatagctcactgcaaccatgaactcctaggctgaagcaatcctcccaccacagcctcctgagtagcggggactgccaccattccttgctttttttttttttttttttttttttttttactttttttctacagatggggtctcactatattgcccaggctattttggaactcctgggctcacatgatcgtcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaactgactgaacgcttgcagagagatgggctaaaggccagtggtatcagtttatcaggatttgtctgccttacactctcttatccttccctctttaccccagggagctggcagaatggtgtttcctctgtaatatgacatatttagattcttttaccagtttaaagaagttaatttaatgggggtaaagggggctaagtttttagggttggggtcaggtactatcctttataagaaagattatgggtgtttgaagctcatgaatggacatgtcattatctttcaaattacatgctaaggatcaggtttgtatcgtatgtattttactatgccttctggtccatatctcagacaaaccactctgtgccagctgtgctaggtgccagcagccatgaactgtgccagagaccctgcctccctggcttaggttgattggactgagtggccacctgtcaccaagacagcccatctgtcacctagcaggtaacatgggcttgacgagctgagagctgggccttttgtattcctctcttaggaaattagaattgggaagctgagagcctaaggcagtttgtaacggaaaagagccaaaagatgatggggagtggagcagtcatgacagttcatgtcctagctagttttttgaagggacagaaaccatgagcaaacagagggaccttgcaagggaggaacagagatgccttgagagacagaagagctgtttcctacagacaccatgaacccagaaccactttccagttctcctgaggcccagctttatcctaccctaggattcaaatgggatacctgtattctttccacaaacctcccttttcttgagccagcttgaatgagactctgttttcccacaatggaaattatcagaccagatctaggctcctacctttacaatcgacttctgggttgagtcaacaacagttggtttacatttaaggctgacatgaagtgctgaagactattctaggtattacggggaacagtggaaaaacacagatacctgattatttctgtcaagctcagtgctgacgttatgggctttgaatccgtgttcctggcaaacagtgagaatgaaaagaggcagggatcctgactgttcatttatcacttcacagctctcaaccaacagggggccttctttatcctatttaacctctcagtagagtatttgccttttgcttattcctctttccagtcaactcttgattattcatgtaatagaggaaagcattaatgtgaatgatagaagactgccccaccttggcctctcttctctgccacagcagcatccagtcacagaaatggaaacaactagcaggagaggtaaggaggctgaaaaaaggtgggatggggccaagcaaattaacattgtttcttctacttttataccttctttctgttaataaatgctgcctgtttgagtttctcttctggtgtcactaggagattgctggaacagcaatgccatttgcttgatttaagtcaaaatatgggatcttttaaaaaactaaaatagagttgggggcaattgactaggctgttagtttcctctcccatctattgtacccccttttgtcagtgccacccagctttcttgttggctgagtttaatgttgggccactagcaaccattctttgttcaggatttgggactcagctagccaaaatatccacaatagcatttctcaaagtatggttcttgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagcagctgttttggaattagaacttaggccttctgacttccaggcaatggtattttcttccagaggtatacatttctgtaaataaagtctgaatgcattggaataacttaccctgggggttatttgtagcagtctcaaatcatttgatcagggtcactactggtgatatatagagggaaataggagagtgaagtaatgcagaacataccttctgtaatttagatttggatcatttttgctgggcctggagaggaggagctaggggagtacagcttacccatggcgctgcttacggaatttagacataagagatggctgttcattattctgggattccacatctgtacagagtgtagaacataactgaatactcagtaggtatttcttgattatgcgatttgctaaaatcactctgctagtgtgttaaaaataccatttagagttttctataccatttaccatttaattgataagcatgtggtttgataaatgttgttgttattattgttattagaagtagttttatgtagttcttatagagatataagggcctttagatcatttgatttggggccctgcctcagctattaaaaattgcattgtaccttaaatacctgttgcctaatattgtttgccttctcattgtgactcttgggggtttctgctgctcagaatagaatggaatctttcataagactggattaaagggcatacggcctaatgcagcagtctctaacctttttggcaccagggacaggtattgtgaaagataatttttccatggactgaggtggggggtgggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaataataaaggaaattcattgaacaccgttaagaaaagataatgcatgttttccttcaaaccatcaatgctttgccccgtcactgatttgcttgtgcgacccttcttttatgtcactctgaataaactcccctttgtctttctgggccgagggaaccaaatgactatagagggactcttattggagtcacacatttctttcctccttgtgactgccaaaccaccaaactctgggccatttgcatgtgtcttaatttctcctcataatgtggcaaaacacgttttggtgctaggtacgatacaacccttcctggagtgaaccaaatgtggaaagtgctgtaatttgagggagttttcagaaaagagcctcttctggtacagaaaggccctttttccttttttctttctcttttttcatttatgcctcatcatattttgtccactttcagctcatctcaggctgaattttccctttgatgtctgctttatagaatagcccttgcctgagaaaagagaacaaaaggccaactctgtggctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgttatttaaaaattcatacaattttaaaggaatagaatagcatatatgattccctccaacctctgacccctgatccactagttcttctccccagaaacaaactgccattaccagattcttggaaatcctgagaattactgcatgcataaacaaggcttgaatattctaaaatggcttttgcttaggtaaccaagtctatccatattgtatggagacatcttgtttcatttattcattcagcaagtacctgatgagcatctcatatgttccaggcactgtgttaagttctggacctacagtgaggaccatcacacagctcctgctctccagaagcttatggtcagcagggaagatcaacatttaatgaaaacatagctaaatataaatgagaaatggtgatatgtgttgtgaaggaaaagaacagcatttacatgcatctgtttttttttttttttttttttttgagacggagtcttgctctgtcgcataggctggagtgcagtggcgccatcttggctgactgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttcccttctcttccagcttatgtcctgggctgggctctggacagggagcagaggcagatgtgcgcatgtgttctggaggacttttatatgtccgatggtgtgttaggcactatgtggagtggaggcagagggaactccagaaaagataaattatcttatggtggagacaaaaggtagtattggcaacaaacatgacctctggaatcagatagttttgggttccaggcctgactctttgactcacttattagttgtgcgaccttaggcaatttatttaacctttctgtagctcagtttccttgtatgcaaacaggaggaaaataataatctcttacataataggattgctatgaagaatatatgaactaatatgtgtaagacattgactgtagtgccaggcacctagtaagcactcagtaaggaataactactgccattattgttgttactaacaacagtatgagactaataagtgattagtgtataagtaccaacaaataccaatggagttcagaaaaagaatgcttaatttttgtgacttatccaggaaatctctagaggagacagaagaagtggaatgaaatattccaggtggagcaaatatgaaagtgggaggctgaactgaactggagtggggaacaaaaagaagaaacaaacgcaacatctggcacccttgagctctaccaccagctcacctgttgtcactaccaatatgtccagtcctttatggctctccattttggagtgccctgaattactggctgcagttttgacttggccagctagttggccagctgctctgactgagcttgagggtgtctgtgccttggtggagttgacacgggtcctaactctgcaacttggtttgtaggttcaaagcctaatttttatcagcttacccagggctgttggtttctagtggattgggtcacactccccaacattacaaaacacttcttaataaatcaccaggctgataagtcgattgatgatgagagagagacctttatagagatgagaacacttgtgtgtatcagccctttctgatatcaaggtacctgaagccaaattaaacagggactgttttataacctaaaatcagaacctaatggagttgaaaagtctcatgagcgagaccatataggctttggtagtccatggaaaactgtacctttttgcatgtctgtcatagctttgtagtgtgaccagaatgtgtgtcctgttctctctccactgctggagaaacatcagtaacaatttttctcttggatgttcctgttttcaattccatgcaaatgctgtttgtgtgctatggccatgctattctcttgaatttcttttttcttgacaagatttttgagttgcctacttctcagcgacaacatagtgattctctcattgagtgttctttttggctttgttctcaaacactaggaatgtttccaagcagggccgccacgaatggctatgcactgcacaaccctaggagagggtgccattcacatagactataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtggatttgatttgcatttccctgatgactaatgatgttgaacatcttttcatgtgcatgttgagtacccgtgtgttttctttggagagatgtctgttcaaggttatttatctttttattgttgagtttttttaatactttagctatttttaatgtatatatttaaggttttcaacttaatgattatatatatatatggaaatcaccacaatcaagataacacatgcattacatcatagagttatcatttatgtgtgtatgcgtgtgtgtgtgtgttggaaatacttaggatctattcttatagcaaattttaagtatacagtacagtattttcacctatagtcgccatgctgtacattagatatccaggacttacttgtcctggaaaactaaaactttgtactttttgactaacatcttactttcccagcaccagccccagctaaccatcattttatactcagcttctatgagttagactaatttacatttcatatttatgtgacatcataagatatttttctttctggctcatttcacttaacataatgtcctttgggtccttctgtgttactgcaaatgataggatatccttctttttaaaggctggataatataccacattttctttattcatgcatccatcgatgaacatttatcttgtttctatatctttgctattgtgaataacggtgcaaggaatataggagtgcagatatccctttgagatcttgatttcaactgttggataagtattccagaagtgggattgctgtgtcatagaataggtctttttttttttttttttttgaaactatactatttttgataatggctctattgatctccatcagcagttttccagggttctgttttctccacacccttcccaatattgccatcttttgcattttttataatagccattctgacaagggtgacatgagatctcactgtggttttcatttgcatatccccaatgattagtgatgttgagcaccttttcatatacctgttgtccatttgtatgccttctttggaaaaatgtctattcagatcctttgcccattttaaaattgggttatttgtatttctgctattgagtttatgagttctttacatattttaaatattgacatcaaatttgtggtttgcaaatatttgctatatagctttttaggttgatgtagtcctaattgtttttgtttgtttgttttttacttttcttgcacgtgcttttgatgtcatattcaaaaaatcattgccaagaccaatttcaagaagtttttcctatgttttcttctaggagttttatggtttcagatgttacatttaagtcttaagcccattttgagttggtttttgtgtgtggtgtaagataagagtctgatttcattactttgcgtgtggatatccagttaccccaacatcatttgttcaagcaagcatcttttcccccattgtgtatttttgaccctctaaggttctttattccttttcatccttttttttctttttctcttctgatgaggtaattttaaataactgttcttcaaatttgctggttctttcttctgcttgataaatctcctgtttttagttgagtcattgtattcctcagctccagaatttgtttggctgttgtttacagtttctatctttttatttaacttttcattttgatcatacattgttttcctgatttcattgagttgtccatctgttaattttcttttttattgttgagtcttaagagctatttattctgaatactagactcctattagatacatgatttgcagattttttctcccattctttgggtcccctcccctcccctcccctttctttcttttttttttttttgagacagagtctcactctgatgcccaggctggagtgtgcagtggtgtgatctcagctcactgcaacctctgcctccctggttcaagcacttctcctgcctcagcaggagaagtaatcccaagtagctgggattacaggcatgtgatgtgccacaacgcctggctaattttttttttttttaatttttagtagagacagagttttgctgtgtgggccaggctggtctcaaactcctgacctcaagtgatctgcctgcctcggcctcccaaagtgctgggattacaggtgtgagccaccatgctcagtctgggatgtcttttcactttcttaatagtgtcatttgaagcatgaaatattttaattttggtgaagtacagtatatttattttttcttttgttgcttgtgcttttggttacatcttagagtctgttaccaaatcctaggtcatgacatgtatccctatgctttcttttacaagttttatagtttttgctcttacagttaggtctttgattttgagtgaatttttgtatatgggttatgaggtaggggtccaacttaattcttttgcctgtggataaccagttgtcccagcatcatttgttgaagagactgttctttctaccattggatggtcttgataccttagtcaaaaatcacttctgaggatttatttcagtactctcaattctattctgttggtctctgtgtctttccttaggttagtaccacactgtctttgttactgttgctttgccataagttgaaatcaggctgtgtaagtcctcccactttttcttttcaaggttggtttggctgtttggggtcccttgcatttccatatgaattttaaaatcagcgtgtcagtttctacaaaaaaaaatgtcagctgggattctgatacgtactgtgatgaatctgtcatttaaaactttcaaggaggagtgtaacaggatcagaatgctattttaagaataggaacctgacaatactatataaaattagagcaagcttgtccagcctgtggactgcatgtagcccaagacagctttgaatgcagcccaacacaaattcataaattttcttaaaacattatgagatttttttgcaattattttaaaaagatcatcagctatcattagtgttagtgtattttatgtgtagaccgagacaattcttcttccagtgtggctcagggaagccaaaagattggacacccgtgaattagagtgatgaaggaaaaacactggatacttggagatcagataggaaactgctgtagtagtttaagaaaatgatagggaccaaactaggaaaagatagtgagggtggatttcagatgtattgaaaaggttgggctgggtgcagtggctcacactagtaatcttagtgctttgggaggctgaggtgggaggatcacttgaagccaggagcttgagaccaatctgggtaacaaaatgagaccccatatgtacaaaaaataaaaaataaaaatagctaggtgtggtggcacatgcctgtagtcctaactactcaggaggctgaggtgagaggattgcttgagcctaggagtttgaggctgcagtgagccatgatcacaccaatgcactccagactgggtgacaaaccaagaccctgtctgaaaaaaaaaaaaaaaaaagaaaagaaaaagaaaaggtctaagtgacaagacaggatttggggactgaatacatgtggggctgagaaaggtgggggatcaggggtaactctgaggtgtgaagagaggctaatggattagattatagtaccttttaaaactttgtattattttgaaatgacttttgacttacagaagagttgtaaagatattacagagaattcctgtatatccttcacccagcttcccctaatgttaacattttacataactatggtaaaattattaaaactgaaaaattagcatttatacaatgcaatatgaacttaactacagtctttatttgggttttaccagtttttttcacaaatgtcccttttctgttgcaggatctatttaggatccttaattgcatttagatatgatctctctttagtcttctctaatctgtggtagttccttagtctttgcctttcacaaccttgactattttgaagagtactgttcagtttactctgtagaatgcccctgatttgggtttatctgatgttttttcatgattccattgagattatacaatttgggcatccaataaggacgatgctatcaatagctcatacttattttattccctacagtgtgccaggcatttgaactaggtacctcaagcatttaaattttacagttaccctatgaaataatactattgtaatcctcacttgacagataagggaactgagcctaaagggttaagtattctctgtaggcagctggacaagggaagttgagtaatatgtcagaatgttgttattgcaaacatggaattaaaacaagtgaagttagaggaattgaaaatttaatatgatttgttgctgaattggctcatagtagggatgaattttctattgaaatcaggataattatagctattatgtattgagtgctagctatgtgctaggcattgtgccaaatgcttttcttgctttgtttcattttgtcctctcccaaaccttgtgagacatagatactatttttgtctctattttacagatgaaaattcctctaatctcttgcccaaggccagagtgctggtgagtggcagagccaccatgtggatccaagtttgtcttaactctaaagcctgtattctttaaccacttggcaatgctaactgtcctccttccatcttcttagtagggatgaatttgccaatgggactagaaaacatgatatttatgggcttggatgtagacactgcttggttgtggacattaccaaatacatgtttgcaactctccttattttatacctcagtggttggtcaaccccattctttctttgggtatatttcaagcaggttacaatctggtctttcaagtctgggattttaacgcttaactcttagtaggcactcttatttcccttttattcaaattcttgagggaagcttctttataaactccttagactgacaaaaatagtaaaatctcagaaataggcaaatcaagggagataatgaaatcaccagaatgggcgtttaaccgtggagtgtaagggaagctttcctggagaaaatagtttaattttgcatttgaagggtagataagagccacaagaggaaagttggaaaaaccatctggaagagggaataggattagcaaaggcacaatttcttgatgttagagatttaaatttaaaaaataaaattatgaaaatgttaagaaaacaataggtgactctgtaatcccactgttataaaagattttcaaagcgtgatatcaaagacagaagccataaagggaatgacaaatacatctgattacataaagatttaaaaagcttccataaataaaaacctatcataaacagagctgcaacaatgacagcctgggaaaattttttgcaataaatttcagtctatattagctgtcattaatatataaatagctctttacaactcagttgaaaagaacacaccagctgaaaaacagtcaaagtgcacagatggtcacatcccaaaagaagaaatatggctggccaatatacctgttagaaaatagtttaacatttctggtaatctgaggcatgcaaattgtgtgtgtgtgtgtgttttgcctgttaaacacgtgataattaccaaatgataatgacctgtttgtcaggttgcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagaggttcggtagagaaggtgggaacctggaaccagagaggttcgcaggtagaggatgaactgggataacagctgatgcctagattggatgcttaggaaagaactaaaggttagtacagggatctttcctgaggaagctgagagagtgtgtggttttgaatggaaccgtggattttttctgggaaaaccagccaaaaaagacctcagttttataaggattgcaagtgcccaccagacctggggatgaggcaggtgggagctataatgaacctgtctttgggactctgaaactcatctatgtaaatgcaatttgctgtccagttgagtttgtgttttgagatgtctcacactgtagagagtagatcttatgagctggctgatggcacaggtgtggggctgttggggtgactccctgtgtgccatgtggtcaagggccagggctagagtctaaagaaaaggagctctcatgagccctggtatgtgtcaggtgtgaagtggaaagtgcattgaactgggagttaagggacctgggctctcatcagaaagcttgtcagaaccttttcccctcagtttcctcatctctgaaatggggtttaataacatggttctgcctgcctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccacaaaaaaataaaaataaaaataaaaaataaaaaaattagccagatatggtggtgcacacctgtagtcccagctacttgagaggctgaggtaggagaattgcttcagcccaggagttggagggtacagtgagctatgattgcaccactgcactccagcctggataacagagtgagactttctcaaaaaaaaaaaaaaaaaaaaaaaaagataccttctatgctgctatgctgatgatagaaataggcaagacagaaaagatgaaacgactaaagttagaaccatgactgatggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaacaggaaataaagagcccagcagattcttggataattgagaatggtgtaaatggctttctgatttacttaagtcattaaagtgttaggtaggggaaaaaggaccccatttgctgcttcaaatagctccctgaaatagccacttagtctcttgccttaggtgagtaactttcagctgcgtgagggataatggatcctgatttcatgtatttcttacttgaacagctcctaaaggaaaggggtatttaaccctgttttccttccttgattttccaaaatgagctcaattattcagtgtaatgttttaaaagtaacatttattggttctatttcattatgaaagtaacaattctcattatggaaaacacagggacacataaggaagaaacatcatccatcccaaatccaagcaccaagagataattttgcttattacctttcttttcttaagaagcagagatcatattgtatattgaggtgtttactgtatcttttctaaatttaacttggtttattgatacattcatataggtgtgtaaatcataaatatgattgctggatttttttttgtagtggtcctttcttttccctttttttcttcagctcctagttctacctttccacactatccctttgtattaccaaaacagtatgtatcttttcacattttactccatgtgcatagatatacacatgcatacacacatacacacacaagttttggaatgttttgttgttgttcattgtttgttttacagaaatagaatattatatatactttaatatatctttttcattctacaatatctcatagaaatctatcacagtctattgatgtagctcttattcttttataatgttgtaaaatattccatgaatgcacaataagttattcagccattcccctattaatgaacatttactttctttgcacatttctgccactacattcaatgcttaaatcaacatgattttgtatatacccttatatactgttgctttcagtttagatatagatgtaggtagaggtatataggtatatgggaatgtttaaatatatatttatgttaatagatatcgccatattgatttataaaaacaggctgttatgctacactttttgcttttgtatgtaatatgtgagattattattttcttcttatccctatcagcaacaggtgttaatggttcttttgtaattttgacaacctaatggatgcagtttcttggctactagtgagtttcagtattatctcaattttttgtccaattaaatttgttcctcgagttgtctattcatattatctgcacattttcctatgggttgtttatatttttctaatttctaagacctctttgtatattttagattttagccctttgtctatcatcattgttacagatacctttcccaaatatgtttatattgacttttttttttttttttaattatttttttagtagagatggggtttcaccatgttggccaggctggtctcgaactactgacctcaagtcatctgcccgcctcggcctcccaaagtgctgggattacagatgtgagccactgcgcccagcctatactgactttgttgatggaatatatttccatataattgtttgcatttttatatccaaatatgactcttttcttatatagcatctgaatttcaagtcttggttaagatagttttcttgaagataggtagccagttgtattggaataatatattaaatgatccctattttaccctgtgatctctttgcagctattaaatgttttatatgctaggatctacttatggattctctattctgtttcttctttttgtctatttgtgtacccaaatctcatatatttgattacattaggctttaaaaaatatttttctggggccgggcacggtggctcacgcctgtaatcccagcactttgggaggctgaggcgggtggatcacttgaggtcaggagttcgagactagcctggctaacatagtgaaaccgcatctctactaaaaatacaaaaattagccaggcatggtggcacatgcctgtaatcccagctactcaggaagctgaggcaggagaatcacttgaacccaggaggcggatgttgcagtgagccaggactgtgccactgcactgcagcctggggaacagagtgagactctgtctcaaaaaaaacataaaaaaaattcttggctatttgttgtcacttgttcgtacacacaaattttaagatcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttctggttttgaactactcttacattattgaaatacacccgctgatcatagtatattattattttgatacattgctgggttctatttgtcaatattttatttagaatcttgcttcaatattcccgagattagagtcatgtttttcttagtgtttttttcttcaagtttaaggattgaggccaggtgtggtggctcatgcgtataatcccaacactttgggaggctgaggtagaaggattgcttgaggccaggaattcgggaccagcctggacaacataccaggactttgtctctacaaaaaaaaaaaaaaaaaaaaaaattaaaattaaaattagcagggcatggtgttgtgtgcctgtagtcccagctacttgagaggttgaggcaggaggatcacttgagcccaggagttcgaggctgcagtgaactatgattgtgctgctgaactccagcttgggctacagagcaagactccatcttttaaaaaaaacaagtttaaggattaaagttatggtggctatgtaaaatatactgcagaatgttccttctttttctcttgtctggaatactttaactaccgttagaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatccttagggatggttttgcacttactatcctgctactaacttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagtttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacacttgaaaagacatttcccattctaaggttagaatgggatttaaaacaatccagttttaaaatagttttaaaaatatttaacttgtcagtccatcaaaaattcattttgtgactagtatgaagtagagtatagcttatattttcccctagagagtcatttatttgagcaccattcatcaaataactattttcctatgattattgctattatacttttatcatacataaattcttctatatgctaggattttttcagcttgtattattcattgatctctctcttgggttttccatcagtttcatacccttatatatgcaacagctggtaaaccagatttcttttgctttctctgcagcctagcgcattacccacacttttttcttagctagtctcaaccattttttcgtccaaatgaacttagaatgtttctgtcaggttctcctcaaaatcctaccaggattttgattggaactactttaaacctaaaatttcattgacatcatcacaacacagagtctgtcatccaggaaaagacatgatatgttaatttattaattttcttttatgttccttagttgctcacatgcatgtgtgtgtatctcatatatttctcatcaagatcatccctggatagttgatagtttatgatatttattatattttcaaactagttattactggtaggtaggaaaatttttgattttgtgtgtctatgcttaattcttatttctaatagtttttcagttgcttctcttggattatttttgaaattaatcacaccagctcccatatgataactttatttccttttaaagaacaaaactgctgttttgctttcaaacctgattgtattggctagatcttttgggataatgttaaataatagcagtactagcaggagtccttgtcttgcttctgattttaatggaaatgtttctagtgattcacttaatagaaatgtttctaatggttcatattagttggctctgatgttgtctgttggtttaagttagatgttttttataatattagggaattaccttattcttaaattatcaagtcctcacaaaaatcaagaatagttggccaggtgtggtggctcacgcctgtaatcccagcacttcaggaggctgaggcagaaggatcacttgacatcaggagtttgagaccagcttggccaacatggtgaaatcccatctctactaaaaatactatatatatatagtatagtatatatatagtgtatatatatatagtatagtatatatatatagtgtatatatatatagtatagtatatatatatagtatatatatatatagtatagtatatatatatatagagagagagagagagagagagacatggtggtgcatgcctgtaatcccagctactcgagaggctgtgggaggagaatcgcttgaacccaggaggtggaggttgcagtgagccgagattgtgccactgcactcagcctggttgacaaagtcagatctgtctccaaaaataaagaatagttgttgagtttagctgatgttttctaggaatctattaagaggttcatttgtgttttctactttgatctccccatttggtatattatattatagatttcctaatatcaatctttgttagctttctaagataaattttccttttcctttgcatgcttgggagagcctcagatttggcttccatactattaatttgattgattttgctctctgctgtctccaatgtgaaatttatttatttttgttacaatgttaatttctctgtatttctttctagctctgttgagctacttaccctaggttgtctttccttctcaatgttttattctagtggctttctatacctgtttcatagagtccatgttttctttcattctattgaggatgtaaacagttttctaaaatatttcttctggtttatacacaaaattaagacgtttttgtttcctctgagttgtcagagtgatatgcattttccttgtgctgccagaggttttcatatgaactttttttttttttttggtaaagcaacagggtcttgctctgttgcccaggctggagtgcagtggcatgttcatagctcatggaatcctcaaactcctgggctcaagtgttcctctcacctctgactccaaaatagctgggactacaggaaaacaccaccatgcttggctaattaaaaaaaatatatatatatatatattaaaacagggttttgcggtgttgcccagtcttgaactcctggcctcaagtgatactcccaccttggcttcccagtgttaggaataaaggcatgagccaccatgcctggtcaggttttttgtatggtttatgaatattcaaaaaaggatctgtctttcatcaaatacagggtatgtagattgcctttgactatcctcaagctcagattctctctcatattggttagaacccttttcagctccattgttggcaggcaggttgatacacatagcttttaacctgtttcacagtgtctgtcagctactcatctagtgggttctgctggacccatatggaatcgtctacccctactacaatgttctcagatgctctgaaccagataaactatgtgaaacagtacagcctcccacatgtgttactacctgagtgttacttgtgagggctcccactcctagcacacagtgtgccagtaccaattctgccatttctgcccttttgattttggggaattagagtctccatgtgaatgtagaccagttttgagaattgctgatttcctctgcaagtagtaaccacgtagtccaaatggatgtccggtttgccagtttctagatgaactcttggcttctaagccatgaggctgacagttgtggaaggactcaatgtttcctatcttcttttaggtttctgtgggctgctgcatgaattggccagattgttttttctcatttcagtattaggcttattgttaatggagatttctcccagatcctggtaataagttggccatcagtttaagttttcagtgtttggggaattttatctttttctatatcttgataggtatttgagtgggaaattgagagaggctatgttagtgattgctagccaagtgctattttaaagtagaaatccagtgtatattttagattagagcagagattggcaaccatttcctgtaaagggccagagagtaaatattttagactttgcaagccatatgatctctgtgttttaactatttaactgttgttggagcatgaaagcatcacagaaaaatgcaaacaaattagtgtggttgtgttcaaataaaactttatttacataaacaggaggaccagatgaaaaagttctggagatagctggcagtcatggttacacaacagtgtgaatgtacttaatggcactgaactgtacacttaaaagcagttaagttggaaaaaattttatatatatatgtatatatgtgtatatatgtatatatgtgtatatatgtatatatgtgtatatatatgtatatatatatgtgtgtgtgtatatatgtgtgtgtgtgtgtatatatataaaatcatgccaataaagaagccaaaacagaaaaaccatattttgctgactctgagtttagaggaattagatctagcataggcagagagagagaggaagaaattacatatgtacagtaggacagtgactctgttaataagctagaaggcagtgggagacatttgagtatttaagaggaataccataatggggatggtgagatcttggaaagctacaattcatcctagtgatgtcatcttatgatctttacagatggagatacacaagagttcacattcacattctttgacataaggatcagagtagggcttttctacttctctagaggcttgagaaacctctgcagctgtcagaagtgttcatatcagaaacaaaagctaaccagtcatttctttttgcttgtagtacaaatggtgactagtgatgcttctggtagttgatctgagctcttcccaggactagaagatcctagcattttagttattaaccacagcacacttactcaataaaagagcagtcatcagtctgagtcaactgtttatacagcctccagcctaagattcttccttatcagctagagacctgggcttaagaatttcacaatgggctgggagcctcttagagaaactagccttttgagactttctctgagttgggctctcttgtttgttgttgttgtttttgaaactgtctcactctgttgcccaggctggagtgcagtggcgtgatcatggctcactgtagcctcgacctctgagttgggatatcttgaaggaatacatgaaggaaaagggaacagagattaaggttttccaggctttgggttgtaatcagacagtttagctgtattctgaacacccagcacttaatgtgcttggttatccatgtgtatgtatcaagggtgggggaactcatggagtgagtcactgagtggtatggtttaaatggcaggaaactcttccctcaccccgccttgggtaagaaaagggcatagcagagcgctgacacacatccctctgctccagaaagtgtacagtacccctctgctccccactgaaaccctaaagttgttcatcttcatgtgtgccaggaaaggagtggatctgtgatgcaaataggattatttggtcatatctgctgactcagtctaaagaagcttttgaaggggatgagatgaaatttcatctatgctgcagagagcaggaggtgcattgctggatggagagaggactgtaggctgcatgtgagccaaggtagacgagggaagcatgggggtgggcatgaggaactggggcagcctgacacgtgatcttggcattgcaaaactgatatcctgttggcctttgggccacatgatatgatgacagtgcagtatccccatggccctttctttttctagatttcatttatgatactctcagatttttaaatagcatgactttccccagggagaaattcagacctcaggtctctaggactgctctgaggtcatgagatagactcagtttgaacctgttgagtttaaatgtcttggaatgattttagcatctcagtaccccctttcccagtgctcatctggtcagctgctctggaacctgagggattctaaactgagacttagtttggggtcatatgcagttaaaaagggacagtcttttggcaccttcacctcggaggtggctgctttttggcttagcgttggactcatcactgaaaaagatagttgagaggttgtttttgacctgagcagccttattaagactcagttattggcaaaggagagaaggctctgcttataaatgttgcagatttaaaggggaaagaggaaaccacagtaagtaaagagcgattcagggagaccagtttctcttttttattcagaatgctgctcaggtatctgctttcctaggagccaccttattgtcaggttctgccttcggtttatgtgtattcttcccttaattcttagaagagggaagatgctttggggttgttcacaggttcccattcgacataaaatagaagctgcctacctttacatatactcagttttatcttctccaagtctcccagaagttctctttgaaagttcctagagcagggactgcttttattttttttccttctcctaggctttaagcatgtatttagatgtatgtcaccattgggtaaaagaaaggctaaagattcagataacttttcccatctgtggaaacatggaaagcagtactcagcagaggaatgaggactgattattttgggcctctttttactttatccaagtgaagaatctactgtgctatatatttgtcaaaagcaattccaaagggcaggggttgggggaaagcagtacggcataataagatttgggcaagttagataggagctgtgcagttggtaatgaagaagcagaactgtttctttctcattataaaagtaatccatgctaattgtaaggaaaagaaataaaatattatagaaagcaataaagaatacaataataataactgataattcctgttaatatgttggtataatttcttcttagttttctgtaggtatagatttcggctcactgcaacctctgccacccaggttcaagcgattctcctgcctcagcttcccgagtagctgagattacaggcactgccaccacacccggctaatttttgtatttttagtagagacagggtttcaccatattggtcaggctggtcttgaactcctgacctcatgatccacccacctcagcctcccaaagtgctgggattacaggcgtgagccaccatttttagaaacaaaataaagatcattctacatatgatactttgtaatatttaaaatataacgggattgtttacccatctaattaagtattcttaacatgatttctgatggctacatagtattccattgtttggatgaacataatataatgtatttaaacactgttctgttcaattcagcatttgatttatcgggtagacatgttttgaagggatcttgaatagtacagtggaattagagttatagttgcggttctgcttaattcttagctctgtgatcctgagcatagattaaagtcttagcttccatttcctcatttgtaaaagaatgctattaatagtaatgaccctcctgagtaaaaatggttagatgacatgacccatgtaaatttcttagcatgaaatctaacatataccaggaactcaataattgttagtagtagcgtatagcattatccttgtcttgacactttgtcatctgtgtactcactgttagaatttgggtctcaaggaaagaaaattgctttcatttagataagtaaaatttcagaatgaaaattgcctttagataggtagcctcttttaccagttgagtaccttccagataggggcatttgccaacttcctgaatttcacagggaaaaaaaaaattctgcagtctctgtggttgtgcggccccatttggttcagaacaaggaagtgggaaaccaccagctgcaaccagggaattatctttgtgtccgcaggcaaagccagccaagcccccctgttctacttatctttttttttttctttacttgcttgttttttatgttcttttagtctgaatttttttttttttgagcagagtcttgctctgttgcccaggctagagtgtagtggcacaatctcggctcactgcaacctctacctcctgggttccagcgattctcctacctcggcctcctgagtagctgggacttcaggcacatgccaccacactcggctaattttttgtatttatttatttttttagtagaggtggggtttcaccatattaaccaggatggtcttgatctcctgactttgtgatccgcctgtctcagcctctcaaaatgctgggattacaggcgtgagccactgcacctggcctggaaatttttaaacatacggaaaagtgaatagcgcagtacatagaatacttgtatagcttctgcttagtctcagcagttgtcctactttctttatttttattttttattatactttaagttctagggtacatgtgcacaacatgcaggtttgttacatatgtatacatgtgccatgttggtgtgctgcacccattaacttgtcatttacattaggtatatctcctaatgctatccctcccccagccccccaccccatgacaggcccggcgtgtgatgttccccttcctgtgtccaagtgttctcattgttcaattcccacctatgaatgagaacatgcagtatttggttttctgtccttgcgatagtttgtggagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatacacccagtaatgggatgactggctcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcactgtggttttgatttgcatttctctgatggccagggatgatgagcattttttcatgtgtcttttggctacataaatgtcttcttttgggaagtgtctgttcatatcctttgcccactttttgatggggctgtttgattttttcttgtaaatttgtttaagttctttgtagattctgcatattagccctttgtcagatgggtagattgtaaaaattttctcccattgtgtaggttgcctgttcattctgatgttggtttcttttgctgtgcagaaactctttagtttaattagatcccatttgtcaattttgtcttttgttgccattgcttttggtgtttcagtcatgaagtctttgcccatgcctatgtcctgaatgctattgcctaggttttcttctagggtttttatggtttcaggtctaacatttaagtctttaatccatcttgaattaatttttgcataaggtgtaaggaagggatccaatttcagctttctacatatggttagccagttttcccagcaccatttattaaataggtaatcctttccccatttcttgtttttgtcaggtttgtcagagatcagatggttgtagatgtgtggtgctatttctgagggctctgttctgttccattggtccatatctctgttttggtaccagtaccatgctgttttggttactgcagccttgtagtatagtttgaagtcagatagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatatcgatacttcctatccatgagcatggaatgttcttccatttgtttgtatcctcttttatttcattgagcagtggtttgtagttctccttgaagaggtccttcacatcccttgtaaggtggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctgatagtttgtatttctgtggaatctgtggtgatatcccctttatcattttttattgtgtatatttgattcttctctcttttcttctttattaggcttgatagtggtctatcaattttgttgatcttttcagaaaaccagctcctggattcattgatttttttgaagggtgttttgtgtctgtatctccttcagttctcctctgatcttagttatttcttgccttccgctagcttttgaatgtgtttgctcttgcttctctagttcttttaactgtgattttaggtgtcaattttagatctttcctgctttctcttgtgggcatttagtgctataaattttcctctatactcagctttaaatgtgtcccagagattctggtatgttatgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgttcagaagaatgtatattctgttgatttggggtggagagttctgtagatgtctattaagtccacttggtgcagagctgagtttaattcctggatatccttaactttctgtctcattgatctgtctaatgttgacagtggggagttaaagtctcctattattattgtgtgggagtctaagtctctttgtaggtctctaaggacttgctttatgaatctgggtgctcctgtagtgggtgcatatatatttagaatggttagctcttcttgttgaattgatcccttttccattacttaatggccttctttgtctcttgatctttgttggtttaaagtctgttttatcagagagtaggattgcaacccctgcttttgttttctatttgcttggtagatcttcctccatccctttattttgatcctgtgtctgtctctgcacatgagatgggtctcctgaatacagcacactgatgggtcttgactctttatccaatttgccagtctgtgtcttttaattggagcatttggcccatttacatttaaggtcaatatggttatgtgtgaatttgatcctgtcattatgatgttagctggttattttgcttattagttgatgcagtttcttcctagcatcaaaggtctttacaatttggtatgtttttgcagtggctggtaccggttgtttctttccatgtttagtgtttctttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccattctcttctggcttgtagagtttctgccgcaagatctgctgttagtctgattggcttccctttgtgggtaacccgacctttctctctggctgcccttaacattttttccttcatttcaactttggtgaatctgacaattatgtgtcttggatttgctcttcttgaggagtatctttgcggtgttctctgtatttcctgaatttgaatgttggcctgccttgctaggttggggaagttctcctggataatatgctgcagagtgttttccaacttggctccattctccccatcactttcaggtacaccaatcagacgtagatttggtcttttcacatagtcccatatttcttggaggctttgttcgtttctttttattcttttttctctaaacttctcttctcattgcatttcattcatttggtctttaatcactgataccctttcttccacttgattgaatcagctactgaagcttgtgcatgtgtcacctagttctcatgtcatggttttcagctccatcaggttatttaaggtcttctctacactgtttattctagttagccattcgtctaatcttttttcaaggtttttagcttctttgcgatgggttcgaacatcctctttagcttggagaagtttgttattaccgatcgtctgaagccttctgctctaaacttatcaaagtcattctccatccagctttgttccattgctagcgaggagctatgttcctttggaggagaagaggcgctctgatgtttggaattttcagcttttctgctctggtttctccccatctttgtggttttatctacctttggtctttgatgatgatgacgtacagatggggttttggtgttgatgtcctttctgtttgtcagttttccttctaacagtcaggaccctcagctgcaggtctgttggagtttgctggacgtccactccagaacccgtttgcctgggtatcaccagcggaggctgcagaacagcaaatattgcagaacagcagatgttcctgcctgatccttcctctggaagcttcctctcagaggggcacccggccgaatgaggtgtcagttggcccctactgagaggtgccacccagttaggctactcgggggtcagggacccacttgaggaggcagtctgtccgttctcagatctcaaactccatgctgggagaaccactactctctttaaagctgtcagacagggacgtttaagtctgcagaagtttctgctgccttttgttcagctatgccctgtccccagaggtggagtctacagaggcaggcaggcctccttcagctgcagtgggctccacccagttcgagcttcctgcctgctttatttacctactcaagccttagcaatggcagatgccccttccccagccttgctgccgccttgcagttctatctcagactgctttgctagcagtgagcaaggctctgtgggcatgggaccctccgaggccaggtgcgagatataatctcctggtgcgccgtttgctaagaccattggaaaagcgcagtattagggtgggagtgtcccaattttccatgtactgtctgtcacggcttcccttggctaggaaagggaattccccgaccccttgttcttcccgggtgaggtgatgccctgccctgcttcggctcatgcttcatgggctgcacccactgtccaacaatccccagtgagatgaacctggtacctcagttggaaatgcagaaatcagtggtcttctgcgttactcatgctgggagctgtagatgggagctgttcctattcagccatcttggacgggcaagtgtcctactttcttatatgtgaattctgaaacgcaaggtcctaactgcactccctgccacaagacagacaggattgcgctacagcacctcacaaagtgggaaaaaaatgtatacactcttagatccaggggtttatagaaacagaaagtcagtgcagaaggactctggactccgggatggtagaaatagattttattttttcagatggagtctcactttgtgcccaggctggagagcagtggcatgatcttggctcacttcagcctccgcctcctgagtagctgggattacagacgcatgccaccatgaccagctaatttttgtatttttagtagagatgggatttcatcatgttggccaggctggtctcgaactcctgacctcaaatgatctgcctgccttggcctcccaaagtgctgagattacaggcatgagccactatgcccagccagatcttttgtttttataatacaaatcacagaaagtaaatcttagtgtctggctgaaggaaagaagtagatccagatgtccatcaacatgacaatgggtaactaccttgtggtatattcataaaagtgaataatattcagcagtgaaaaacagatgaagtagagctacatgtataaacatggataattagaagttaagtgaaaaatgtaatttgcctaataatctttctctatacaatgtaccatttatttaagggtataaacatgaaacaacactatatgtgatttgtagatacatacaaacataataaatgtataaaaacgtgggcaacaaggaagtcaactactttagagtagaggttccccttgtagatggttgggtgagatgaatcgtattcaggaagggtacatagaggacaactgaatcaataatattcaaatttattaaagctgtatggtaggtgcagaggtgctaatttttaaaatattttactgtatgtttaaaactttaagtgtaaagaaaaaactagggcagaaaaacgttgtttaaaatgctcagaatcctggatcacttattttgtgagtgtgaaagctgagactgggagagttcagtgttttgcttctcatatacatttttgaattttgttcaattatcatacagccaaattggcttttttgggaataaagttctatgaatcttaagacatgtatagattattataattactaccacagacagggtttagaactgctccatcacttctaaaaacttctcatactcttcctttagtgtgacacccagatttctaaaccctggcaaccactgaccagctctgcaatcactgtagttttgtcctttggagaatgtcatacaaatggaaccttacagtgtgtaacctttagagagtgggtttgtttacttagcataatgcctttgagattcatctgagttgatacatgtatcaattgtttattcctttttatttctgagtggttttccatggtctgtaggtaccacagtttgtttatccattcagccattgaagggtacctggactgcttccagattttgtctattatgaatagagttgctgtaaacattggtgtagagggttccatgtaaacataagttttcatcttagtagggagccaggagcagaattattgagttgtagggtgagtactagtgtttttaacttatgaaagttttttctttttctttttttattaaaaaaaacctttataagataccatcaaatagttttccaaatcagtgcttttacatttacattcctaccaacagtgtatgaaaattccggtttctgcacattgctattgtcttttttgttgttgttgttattatagcaattcagatgagaagtggcatcttattatcgttttagtttgcatttctctaatggtagggaacatttttatctgcttatttgccgtgaaaacaacaacatattcaataacaacttcttttggtgaagtgtctgttcacagttttttcagccctttttttttcttctttttttttttttgagagggagtctcactctgccacccaggcgtgatcttggctcactgcaggctccgcctcctgggttcacgccattctgctgtctcagcctttcacgtagctgggactacaaggcacccgccaccacacccggctaatttttttttttttttttttttgtatttttagtagagacggggtttcatcatgttagccaggatggtctcgatctcctgaccttgtgatctgcccaccttggcctcccaaagtgctgggattacaggcgtgagccaccgctcctggctgagttgtgtgttttcttattgttgaatttcaggattctttatatattctggataaaagttctttgttggatatgtgatttgcaaatattttatcccatgttatatgttatatagcttatcttttcattgtcttaaagtgtctttcacagatcaaaagtttttcattttgattaatgtcagtttatcattttttttttcttttatgtattgtgtttttggtgtcatgtctaagaactgtttgcttaactgaagatcacagattttttcatatatttccttctaagacttatagttttatattttctatttagatttatgacttagcttttatataagttgtgaggtttaggttaagtttgttattttacatatgaatgtccaattgcttcaaccgcatttacactattttcaaaaatcaaatgattatatttgtgtgggtcaaattctggactattatgtttcattgattgatgtgtctattcttgggcaatactgcattgtttcggttgctttaactttgtagtaagccttaaaatcaggcaatgtgactccttcattatctgcttcttttacagaattattttagctattcctgtttctttgaccttccatatacactttagagtcagtctatctataaaatatcctgttgggattttgatcagaattgctttgactctatagatcgttttggtgagaaatgacatctttcctatgttgagcctttcagtccttggacaaggtatgtctttccatttatttaggtcttttattttatcagcattttgccattctcagcatatggatcctttaaatattttgttagatttatacttaagcatttcagttttttgaaacattttaagtggttctttcaaaaatgttgcttttcaattgtacactgctactgtgtagaagtgattgatttttgtgtgttgacttcgcatcctgtgacctttaaaaactaatgtattttttaggagcttttttgtagattccttgggattttccatacatataatcacgtccattgcaaataaggacagttttacttcttccttttcgatctctattatttttgttgcctgatttcctcgctaaagttgccagtctaatagtagtggtgagagtggacatccttgtcctgtttctaatgttgtcggggggagcatttagtctttcaccattaagtattagattaggcatagtaattttaggtgccctttatcaggctgaggaagttccctacatcaggttgaggaagttccctactattcctagtttgatgataatttttatcatgaatagatactgaattttgacaaaataccctttctgtatcagttgatatgatcacgtactttttagtcttttttagtcttttcagcactgatttggtgaattatattaattgaatttcaaatattgaactaaccttgtgttaccaggagaaaacgcacttggtcatagagtattattctttcttgtttttgagatggagtctcgctctgttgcccaggctggagtgcagtggcacaatctcggctcactgcaagctctgcctcctgggttcacaccattcccctgcctcagcctccggagtagctgggactacaggcgcccaccacctcgcctggctaatttttgtattttttttttatttttatttttttagtagagacggggtttcaccttgttagccaggatggtctcgatctcctgacctcgtgatccgcccacctcagcctcccaaagtgttgggattacaggtgtgagccaccgtgcctggccaagtattattctttctatactgctactttagatttgctaatattttactgaggatttttgtgtctgttgttcatgaggaatattggtctgtctgtccttccttccttccttccttttcttcctgcttccttcttcttccctcatcttcttctttttcctctattttcttcttctcttcctctccttcctccccactacccaactcctctagttttggtatctgggtaatgtagtgatggaccattctgtttaattgattgatgtgttcattctttcccctcttcaactcaacatgagaaatgtttccttctcttttattttctgaacaagattgtataaatatttggtagaattggtcactgaaactgagtctggagatttcttattcagatgattttaactatgaattcaatttatttaatagtattattcaggttgtctttttcatcttgggtgagttttggagtttgtggtttttgaagaatatgtccatttcatctaagtggtcaaatttatgtgcatagagttggttggagtattcttttataattttaattgctagggttctaatatcttctttcattgctgatattgttaacttttttccttctctctttttatccatgtcattctacctagaagtttataaattgtattgacttttttcaaagacaaacttttggttttattgatttttttttttttttttgagacagtgtctcactctgtcgcccaagctgaagtgcagtggcatgctcatggctcactgcagcctcgacctcctgggctcaagtgattctcccacctcagccttccaagtagctgggactacatgtttgcaccactacatccagctaattttttaaattttttttgtagagacaaggtttcaccatgttgcccgggctggtcttgaactcctgggctcaggtgatctccccgccttggcctcccaaagtgctgggattacaggcgcgaggcactgagccctgcctctctattgtttttcttttccatttcattgatctctgctctttattatttcattttttctgcttgccttgggtttattttgctcttattttttttattcttaaggtggaagcttagattgctaatttgagaccattctttttgcctaatataagaatttccagctgggtgcagtggctcatgcctgtaatcctagcactttgggaggccgaggtgggtggattgcttgaggccaggagatcaagaccagcctggccaacatggtgaaaccccgtctctacaaaaaatacaaaaaaaaaaaaaaccaacacaccaaaaactgggcatagtggcaggcacctataatctcctacttgggaggctgaggcaggagaatcacttgaacctgggaggcggacgttgtagtgagcccacatccggccactgcactcccgtcctccagcctgggtgacagagtgagactgtgttaaaaaaatttttttcctgttactagcatatttttgttgttgttgttcagttcaaaatattttataatttcctttgagaattcctatctatgaatttgcctttccagccatccagagaatttgtcatctgttccatatctttttgttcttggttgttatcaagtactaaattaaaatagaattcatctcgtgaaggatcataatagcttcatttgttatgaataatgtgatattcatttacattgatctgttaaggataatacagccactgtatattgagtgcttattatattctaggcactacattgatcactttacatggtcttattttattaaattctctaaccctttcagtaggtactcttattagttcaattaacaattgtgaggcaattgacacatattttaagtgatttgtctgtagtcacttggccagtaaatggtagggatgggatggaatgtagacttgattccaaacccccttaaccattttactacatttcctctagttatttcacttcttgccttctcataaaaattgttagctttttgagggcagatactgtgtcctacttatacttatcttcttttccctacaatacctgcaacaatgttaggcacacagtaatggattgactaatgtttgtggaactaaattcaacaaaattaactgatctagaagagaatcaaaaccatggtgcttgccatattgcctcagattcttaccagctaagcagactcagtgtagcatcctatacaaaaccaaaaaagcttataggaaatatttgtgtcagtaataatggctatcttgtgttcttttgtgatgatcagtcagatgtggccacaagagtagacagaggagagggtaaggaaaaaacaaagtttattatattcactggtcccagagacaagaggctcaggatactaggcaaggccacttgggaaagacattagggtggtcaggaggcaggagataggagcaaggaggaagttttagtccactgcctttattggggtttccacagaaaaagcagggcagggcaggacagggtgaatagttaaggattggctagtttgaatagtttcagcaggcctctaagctgtagggctgcaccctagttgtctggtgtctggccctggggcaattaaggaagaggaatatagcctcctggggtataaggggcagatagaggaggtctggctttggattggttagtttgcatatcaaaggcatgtttctgggtgagtacttgctgtctctaagaattggctggaggatgggggtcggggtgggggcaggctgtctctagccagaaaggtttttaaagataccaaaatatcacaatatacagaaaataaaatatatgctgcatatcaagcaattcaactttttcttgtaatatcatgacttttctttgcttcttgggagcacttccagcatgactggtggcacttcatctggatcccctggtgttattcaggggttacagtatcacactaaacaggatggaaaacatgagggaagggtcgacccttgaacaacatgggtttgagctatgcaggtccacttagaagcagattttttcaataaatatattggaaaaaggtttgggggtttttgacaatttgaaaaaatttgcaggcaagtcttatagcctagaagtattgaaaaagattaagaaaaggttaagtatgtcatgaatgaataaatacatgtagacactagtgtattttatagtttactactctaaaatatacacaatctattacaaaaagttaaaatttatcaaagcttatgtacacaaacacttatagactgtacattgtgccatcgtaattgagagatgtaaagatataaagatgcactattaaaacataactgcataaaattagctgtagtacatactgtactcctgtaataattttatagctgcctcttgcagtgagctcaggtgttgtgagtatcccttagaatgccctgtgcccctgatcatctccgaatgggctgttctttctccagtaaatggttgatcccaataaaaaagtgatccttgtggttctcgcatttttcatggtgtttagtgcaataccataaatgttgaataacaccagaggacccatacaaagtgcactagtcatgctgaagtgctcccaagaatcagagaaaagttaagacattacaaggaaaagttgaattgcttgatatgcaccatagattgaggactgcagctgcagttacccactattttagacgacgattcatcttgtgaacagatgatgcaaacttatggtattgataaatgtagtacagtactctaaatgtattttctcttcctcatgactttcttaatattttctcttctctgtaagaatacaatatataatacatataacatacaaaatttgtgttaattgatctcagtaaggcttctggtcaacagtaagctattggtagttaactttagaggagttaaaagttataggcagattttagactgctcagggagtcagtgcccctaacctccacattgttcaaagatcagctgtatatacaatacaaagaccaatactctgagctggtaaggaggtttataagtatgactaaccaaatataagtctgccccaagctctgctttttggttctggccttcagtctgtccatctgctttctctggacctccttctcatactttgaattttttaagtagtttgtccctcatatgattttttttctattcctttttcccttcctgtccttccttcactcctttccctcccacctccctccctcccttcctctctcccttccttccttccttccatccaaccatccatccatccatccatccatccatccatccatccatccatctatccatcttgaggctttaggtgagttcttcaccatttatttaacaaatgttttatatgagtcttactatatgccatgcacattttaatgcattttttaaatataattcccataacaatcctatgaattgggtactattatggttcctattgtacagatgagggaactccctcacaggactttctagtggccctatagccatttgccacacccattacaaatttttgtggcaggctggaggggggtataaagttaaaacaaaggcctctgcttctgagttggtcagtcatttacctgtagagctgtgctttgtcggtaaagggcaatgtagttgtgtgatcaggatagttgccacagaacacacaaggggtttaggcatgaccttccttgccccattggcacgcaagaactttttccttcctggcctgcagtctgatacatacacacatagaaacacagacacacacacacacacacacacacacacacacacacacacagacacacacacagagagagagagagagaatgagagagagagagagagagagagagagagagagagagagagagaacatatgtaacattcatgccatggatttaaagcagagtacaatggcaaaaatacaatcttgaaacttggcgacatctgagcgtgacttcagcctctgccacttattgtctgtttgatcttgggcagatcacttaatcacttggagctttggttttctccactatgaaatgaggaagatgatggtggttataataaaaactctgatgactgaatgagatgatatatttgaatccttagcccagtgatttgcacatagaaatgttcaatacatgttagaaatgtttgtgattattaatatgcaaggcttctttatgtattaaagataattcaccctctagcatatatatagcttgtataaactgaattttgagaacccagagcaatgcttgtctttatctagggacttaactgttttggatcttgatgttagttttatcttcatctttggccgtccgtaggtcctgatcagttccatcaacctcaagatttaacttttggtgtccaaatgtctaattggccctgtgcaaatgctgacatttcttttgaggtccatggcaaagcctggcaccagaatccagcttttttttttttttttttgagatgcagtcttgctttgtcactcaggccggagtgcaatggcatgatcttggctcactgcaacctctgcctcccaggttcaagtgattctcctgcctcagcctcctgagtagctgggactacagacgcctgccaccatgcccagctaatttttgtatttttagtagagacggggtttcgccatgttggccaggctggtcttggactcctgacctcaagtgatcctcccgcctcagcctcccaaagtgctgggattacaggtgtgagtcaccacgcccagcccagaatccagctttcatctggactgttgatgtgatttttttttccctctcccagagtgagtctttatgttgtggctgtcacataggagggcccaggggcagggttaagccagattctacttcactgaaggcctggaatggctgttaatagctcctgctatagacagtgaggcttgagccagattttttagtactccatttgtcagacacggggtgccaccttgaatgacactgctgaaaaaggattgtggtaacctggccagccccagggaggttggagtgacattgcgttggtgtgcctcttcccttttatggaccaggccaagccctattaacctgaaggagtgtgatggccttgtttagccaaacagccttttccactttagtcatcctttgaaatcttattaagccaggggcagggaaggaagaaggaggcagacagactcttgaaactaaaaggagggaaagaggaacattctaaccttccacctgaggtcatactttggcaggaggaagggaccagggaattttatacaaggcagcaagagagatataagagtttggggtctggagtcagataaacctggttttgaattctgactctactctcttatgtgtggtgttgaccagatcacctcacttctctgaaactcgtttccttatcaacaaaatgggaaaagtaattgtacctatctcagaagattggtataaaaattaagcaagaaagttcatgtaaagcagttaatcagatacttgcctggaatattattatttttcttctggttcttgattaaggatgcctggaatatattaagtgcataccatcgctattcgcaaagttttggtgacaaagaacaataggaagaaacagcctaggggaagtgaaaagcagtcttggggtttctgtgccattctccggggtctccttgtaacatctttcagtctgtctcccttcccttcttccctttttcccttcttccctcccctcccctcccctcccttcccctccccaagtcttgctctgtcgcccaggctgtagtacagtagcatgatctcggttcactgcaacctccgcctcctgagttcaagcgattcttgtgcctcagcctcccgagtagccgaggttacaggcgcctgccaccatgcctggctaatttttgtatttttagtagagacggggttttgccatattgtctagggtggtcttgaactcccgacctcaggtgatctgccagcctctgcctcccaaagtgctgggattataggcatgagccaccgcacccagccacatctcttagcgttacaaacacatctgtgagtgccaagagaagaggtaaagttctagagagtcttcaacatgtggactgttttcccagccagggcataggaggtatgctgtgtgtgtgtgtgtgtgtgtgtgtgtgtgtgtgtgtgtgtgtgtgtgtgtgtgtgtgattgagattgacatcaacccccatctagtgttgaggtctaagaggcgtgttgcctcggtggtggttgtccatgacccatcaaatcaacgtttcttcaagaggaacagactgtcattcttttcatctctcttagtagtaaagaaccatttgcctttaataatgaaggaagctacttaaatccatccccagagccctcacaagcagggtttgttcctgagttaattgtgcttgacttatgaagggtttctaatgagtatgtattttaacaagtctggcattgggattgggaaacagtatcattaaccagtgctggagaccagtggttttcttcttcttttttctttttgttttgcttttaagtcacagagcccaatatgtaaatgaaagcctggaaggctgcccacttttgctcctgagggcatttctaagaaagtggggaaatatagtttgcaaaacactgcagttggcttcctgggttgtagcaatctttttctgtttaggtctctgtttggggaaaaggattatacatgacagtgtaaataagcagccatgttataataaataggtttctactgtaataacagaacacttacctcccgcagttccccttttctaatgccgcccaagctgtagcagttgaagccgttgattgggactgactgaatgtttagggaacacagagctcattatttaataaagtgttgtaaccaaagtatgttcaggaagtgttcaggggattctgagccagtgatggtgctcttcagaacatttcagttaatacaaaatatgccactattaattcattttgtgcaaactccagtgccattttccacagagagcaacttgtatacatagttctcttccatatgccgtggcttaacctgatgtgtcttttttctccctttgtatcagggtctgagtatgacctgaactttatctttctccccctctaggctacagatgcacatgttgaatggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctcaaaacaataaaaaaataaaataaccagggcagaccaaagcctatacaaactcttggagaggtttaatggaaagaaagcagctttcaggtgttctaaggggctctcgttagattcaaccacattggccttgaataatttgctgtgggagcctcataacctgtccacttctccaaggacttcctagggcaagaattagattccttccccatccacccaaacccatgggccagtctggaccaaacagcccctcatggctagcagggagaatcccatggttgcagcgggctgggtgataaaccagcccagaaagaagcaggagctacgagccatgtcctcagactcccaaatgtgagactgtggaggcattagcaggtcacattgagaagctcagaaaaagaaatcacttataaaattattactactgctttctgacttaaatttgccttaaacattaagatcatagtttaaatctttaattgataatcatttttggatagcattttacagtgtacaaggtttttcgcataacagtgtttgaggtagacagggcaagaattatggcctcttgttttacagaggaagaaaattttactcagggagtaaaattccaagtggcagttaggattggagcctaagcctcttgatcctaagatcacagctatgctttgctccctctccacaaatattcctgtcatctcctccccacaaatattcatgtatacctttatgatagttacaattttcaagatgcatgtcatatatcagtagaaattatagagaaaacattcatctaaagcagcgattttgaaccctagtatgttccaggctcacctaattagcttgatttaatcatttcacaatgcaaacatacatcaaaacatcatactgtacgtaccttataagtacccacaattatttgtcagttaaaaataaaattaaaaacaaacactgatgcgctgccccacccttggagaggatgagttcatgatctgtgataaagcctgagcattgtgttttaaaaagttccccaggtgattctagcatggagtgggagttgagaaccactgatttcatgcaatgattctgaaacgtaatgttcatagcaatcaactgaagggcttgttaaacatgaggcttgtcaggccccatccccagagggtctgattgagagagtctacaagtaatggcagggactgaatgtttgtaacaagtccccaagtgatgccaatgcaggggtccttagaccattcttggagaatcactgtcccaggtgttcgtaactcacagttactccaagtgtgtaactcaaagtgtggtcctaggatcagcatcacatgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacatatctccctgggtctgctgaagtatccttagtccctttatcaataacagtagcggttgctgggtgcagtggctcacacctgtggtcccagctactcaggaggctgaggtgggagtatcacttgaggccaggagtttgagaccaacctgagcaacacagtgagaactcatttctaataaaaaatttaaaaatcagctgagcctggtggctcacacctgtaatcccagcactttgggaggtggaggcaagcagatcatgaggtcaggagattgagggcagcatgatgaaaccccgtgtgtactaaaaatacaaaaattagctgggcgtggtggcatatgcctgtaatcccagctacttgggaggctgaggcaggagaatcacttgaacccaggaggtggagattgcagtgagccgagatcacgccactgcactccagcatggcaacaaagtgagactccgcctccaaataaataaacaaataaatagaaattaactgggcatggtggtgcaagcctgtagtccaggctgcttgagacttccgccctcccttctgaggtgggaggattgctttatcctaggagttcaaggctgtagtgatttatgatcatgccattgcacaccagcctaggcaacagagtgagactccatctctaaaaaaataaaaagtaacagtagcagcactatcagctgctgattcttgagtgcttactatgtgccactgttctaagtgctttacatggcttagatttatttaatcgttgcaataaacttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttggggccctcagtgaatttccatgtgttctactctgccctgtgacttactggcaccaggatttgcaaatcagctagagaatgcctaggcttcagtttctctgggttctccatctttaaagctgaaccctaaaagaaggactgtgtattccagtggcccatattacaagtaagtgctctttacacctaggatcctggaaaaaggtctttttctagattcagatgaattatattaaagggcaatttccagtgatatgcccttttgtttcttggagtgaaggaggggaagtacatgatgaacctattgattattagattagcagggagctcaaagcttgtctgatgtcatcttatcttccagagggtaaatttaggaggataaatgacgagtttcagtagtcaaggtgggtgtccccagaacccatatctcttgactgagacttcagaattatttttctattccatgaatgaaattcagggagagtttgtgtgctggtgatagagtctcttccttgataaatgcacaaacacacaattttgcagacaatttcaggagggacacagactacaacttcctctcctagcccctctcccctctgtaagcccacctattcatcccatgttaatgtcttcctgcctaggctacaaatagttcatagtttagggaatagatgtgctgtctagtgtgtgagttccttgttatagccgctggccatttgtcctgatggtgatactgggttccttatctatacccgtgactttgcaaagaatatcatccaatccaggataaaccactttcaggaaattaaagccaaggagtggaagctaagtagggtgtccatggaacctggttacagattagattttcagttacagtactcacgtgcaaagctagtgatctggccctgaaatgagacactgggcccatgctgcaacttcagcgctctgcttttcaccctctaacccccatgagagtttcttctgaatgcagaatgttgttagcaagggagactggatacagaaaagaaagtgaagatactatatcagccctcttcccagaccaaaaactctagcctggcctgcatttgtgtttgtacccatctgtcttctactaggagaagcatgataattattcttttcatcaagctcctttcttcttcaaggcctaaagcctcaagtacattattatcttattatcaaacttgcccattattatatatccatgttgatctattatgttagttcctttttaccccctttactaccactctccttttgcccagttctttctgctctgttggatgggatggttcttttgagtattcctaactttcagactgagtggaagaagatagtaatgattctgtcattactggggtgtctagcctccattcacaaacactatattgatgttcttgggatgcagcttttccactgacacaccttgtacccatgtgtgctgctggaaaaaccttgttgtcaccaatgcagataggcttgaaaatctcactctttgctaattggcacatcgaaatgtgctagttgacctagaaaagttatttctgtgactggcaaattgggctattttaaaaagttatagtttggattttggacctgaactgaggacagaatgtccctttattatcctgagggttcttaaagcgtacaaagcttggtttcaaaagaggtattaattttctaaagaattgagtgaggcacaatagtgcctcaaccttctgcaaaggccagtatgtttctgatcagatgaatgcattgtgtctgaggatgtggggggtattgagatgagtttgggattcctggtccaaaccaaattctagggactatcctagaatatgtcaacttagtagctttattttaagactaagctttgagggtcttaaatccttgatgaatccagcctagatcacaccagtcaaaccacagatttttattgagcactttcctgtgttaagtatcatgccatgtgctgcagaagatacaaaaacaaccagtgtacattcctggtcctcaaagaacttgcagtttagttagaaagataaagtataaatgcctgaaaagttatggcaatattaaagttgaaaacatgaaaaaggaaaaatcatggttgggcatggtggctcatacctgtaatcccaacattttgggaggtcaaggcaggaggattgcttgagcccaggagtttgagaccagcctgagcaacatataagaccctgtctttacaaaaaataaaaaaatagctgggcgtggtggcacatgtttataatccaagctacttgagactcaaggctgaggtgggaagatggcttgagcccaggaggtcgaggcggtggtgagctatggccaacactactgcacttcagtctgggtgacagagcaagaccctgtcacaaataaaaaagtaaaacttacaaggcattcaggcttgactgctaaattgcagttgctctatgtttcaagaaatgggaaaaagattaatattagcattcactgagcccatactattttccaggtaatttacacatatattattcaattctcataagaaacccattttacatatgaggaaactgaggttcagatcagattaaacgacttgctcagagttacatcatttgtaagtgctaaagctaaacctgtgcactttgtaccttaatacacagcctcctggagtaagtggtctggaaaggcttcatgaagaaataaagcctgagccaagccttgagggatggttagaatgtgcatgcaaattgcataggaaggaggctgttcaagctaagggaacacatggacatggaggcagaaaatagtcaactaagtattgagattctgaagagcagggtgggagtcagggattccagttgtacacagagacattaccacttatttgcaaatcacaagaagacactgtttctgtcatgtctcttaacccttacagtatttagattttgtgtacatttcctatcttttcaacctccacaaataagaatttcttatgtgtggatgggactttggaatcagaatagctcttttacacatatctcaccctagtgtagttgttaaggggattggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacctcagttctctcatctataaaatgggggtgataatagtgcctatttcataaagctattgtgaggattaagttagttgatgtgtgtaaagcaaatagcattgcactgttagccattattagtctttgatcctcaccaaaaccctgtgaagtgtgtattagcatgtccattttacagacagagccttagaaagtttaagtaacttgtacaggggggcacacaggaagtgacagaactagcatgaaaactttggtctttctgataccaaaggtcatcataccaaaggaaggtttggtcttcttctctcctagttatttagattgatttttaagtattcagccatatgaccgccttttggcaaattttatacagtatcgattagcaatttgggggcttaattttacttttaggatttttttgttacagaaatagtagatgctcatgactacagtagcaataatatattgtatatttcaaagtagctagaagagaggacttgaaatgtttctaacacatagaaatgataaatactcaagggcatggataccccaaataccctgacttgatcattgcacattctatgcatgcaaaaaatactcatgtgcactccataaatctgtaaaatattatgtatcaataaaaggaaaaagatttttttaaaaatgagatatgtgaaatatagtgaattatttcagataagttctaggaagaaaaataatacatggtcattgaaaagtaactcagaggactataaagaaaaagctaatcattttaccagcttttagtcctgttgcctcaagggtaaattgtgttaaaagtatctttttacacttatcctttgcttgtacatggagattaaagattttcatatttctaggattgttggtttatttgggttccagcttcttacacacttggaattctacaaataccactccagtatatttctttctcttttttttgaagtctcagtctgccacccaggctggagtgcagtggtgtgattttggctcactgcaacctttgcctctcaggttcaagtgattctcctgcctcagcctcccaagtagctggggtcacaggcatgcgccaccacgcccggctaatttttgtatttttagcagaggcggggtctcaccatgttggccaagctggtcttgaattcctgacctcaaatgatccacctgccttggcctcccaaagtgctgtgattacaggcgtaagccaccatgcctggcccagtatatttctttgtttaacttaaacactagataatcagtaatctcttcaggcatggacataactcttttcatccatagtttggttggactatatattcatatattccttctattctctgtgggtaaggacagtgtcttttttctttcaagtgagcagtttaataggataaaaatattgcggaccactgacctacttcaaacccctcatgttacacaaaaaatagacacagagagatttgttccagggtccactgttagataatggtaagctgaagtacagacttagaattcccgtttgtttacttcaaatccaggactcttttctgctttgccattctcattattcccgagttctgaagaccatagtttccacagagtgcatgtgcaagtggattatcgctggacaccaaattccaaatgttcaagtacacatcatttcagtacacacacatgtggctagtgtcctttccaacctttgccaaagtaccacctcactttatgaggcaaaatgtgtaatggagtcaaagtccgaagaaccaagcagtagattgtagagcatggatagagatcaataataaatacttcaaagttcaaaaatggcgacatttgattcattgtgaattgacttgtagaaagccccattggagctgaggacaagtgtcttttgttttgtggctgcccctacatagccttgtacttagcacctggtagatatctatagatagaataaatgaattcatcagccaacctgaacctctatgttgcttagggaaattctggggatccctctcacatatgtcctgggatcttgggtgcaaagacagaggggtgatagataatatttttttccaggagaatttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacactcatttaaaaattttacatcattttatttttggcacctaataattgcacatattttggaggtacattgtgatatttagatacagacagtgtgcgaagatcaaatcaatcttgttagcatatctgtcacctcaagcatttatcatttctttgtgttgggaacattcaaatcctctcttctagctattggaaaatatacaatacattattgttaactatagccaccctacatggctataggacattataacttattccttcgatctagctataattttgtatctgttaaccaacctccctatctccaccctccccagcctctagtaaccaccattctactttccctttctatgacattaactttgttagctcccacatataagtgagaacatgtggtagttatctttctgcacatactcattttttaaaagcactccaggcaattccaatgtgtgcaaccagggcagctctgctgtacaccttgttctagttctgccctgccactggctggggcttggggctttgaaggatttaatttcaccatattaagtatcagtttccacatttttcaaatgggatttgtaaaatttaccctctctacctttcagacaagttataaagaaaagataccaaaagataacaatgaaaagataacaaagagctttggaaagttaaaagcactacacaaatgagcacttgccttgttctctctttgacttcagtcacaattttttgtaaagggggtttaattgacatataatttacaaatgaaaagtttatccttttcaaatatacaattcagtggtttttaatatattcacagagttgttcaattagcaccacagtctaattttagaacactttcatcaccccgaaaagaaattgcataaacattagcatcatccccattccttctttccttgttctggacccaggaaaccactaatctactttctgtctgtatggatttgcctattctggacatttcatgtaaatgtaaccatataatatggcattttgtgactgacttctttcactcagcagaatgttttcagggttcatccatgttgttgcatgtatcagtacttcattcctttttacggctgaataatattcctttgtattatatatcacattttgtttagccatttgtcggttagtgtacatttgggttggttctaccttttggctattgttaatatgctgctatgaacatttgtataaagctatctgtttgtctgctttggagtatgtacctagaagtagaattgctgggtcaaatgataactcagtgtttaaactttagagtaactgccagactattttccaaagtggctataccattttatatgtccaccagcaatgtatgagcattccaagttctcaacatcctcactaccacttgttattgtgtcttttttattatagccattctagagggtgtgatgtcgtagaggttgagtatccgttatccaaaatgcttagaactcgaagtgtttcagattttggaatgctgcactttgtacttaccagttgagcatccctagtctgaaaatctgaagtgcttgaatgagcattcttttgagcatctctttaatactcaaatttgacccagccatcccgttactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagctttaggagatatacctaatgctaaatgacgagttaatgggtgcagcacaccagcatggcacatgtatacatatgtaacctgcacattgtgcacatgtaccctaaaacttaaagtataataataataaaataaaataaaataaaaaaataaaatatctgataaaaaaagtttcatattcaggaacatttcagatttcggatttttgaatgctatttctctgataactaatgatgttgaacactttttcatgtacttactagctatttgtatgtctttttggagaaatatcttttcagatcctttcccaaattttaattgggttgttttcattgttcagttataattgttctttctggatattaaacccttatctgatatataatttgaagcattttctcccattctgtgggttgtcattgcatttgcttgattgtatcctttgaggcacaaaatattttaattttgataaagtctaatttctctatttttgatttggctgcttgtgcttttggtatcacatctaagaaactgttgtctagtccaagatcatgaagatatatgactgttttcttctaagagtttcatagtgttggctcttacatttaggtctatgatccattttgagttaatctttatgtgtagtgtgaggaaggggtccaaattcatttttttcatgtggatatccagttgtcccagcaccatttgttgaaaagactcttctatccatccccattgaaatatcttggtatcctttctaaaaatcaatgaaaaataaatgtgaaggtttatttttagaccctcagttctatctcatttctctatatgtctatccatatgccagcaccacactgtcttgattgctgtagctttgtagaaagctttgaaactgagtgtgcattgtaacaagatcttctggggattagtgtgtgtgtgtgtgaatgttgaaaagggctggaaagcaaagttgaaagaaagcaaaatgagcaatatagtgttcagatgataaggcccagggggattgactagcctgaggccacatagccagtgattggcagatcttggttcagcactcaggtcttctgacttccacatcagtgctctttccacctcccctgttgcataagtactgaatgagatgcctttggttaatggacactctgagcaagagacttcagggttatttaagcaactgaactttgctcaatcgcctcatctgtacaacagaaatattacctctatcactggctgggcctggtggctcacgcctataactgcaacactttgggaggctcaggaggaaggatcacttgagccgaagtgttgagaccagcctgggcaacaaagtgagaccctgtctgtacaaaaaataaaataattagccagccatggtggcatgtgcctgtagtcccagctagtcagaaggccgatgtgggagggtcacttgagcccaggaatttgagaccagactggccaacatagtgagaccggtctctaccaaaattttttttaaaaaattagccaggcgtggcggtatgtgtctgtagtctcacctacttgggaggctgaggcaggaggatcacttgagcctaacagttcaaggttaccatgagccatgatcatgccatacactccagcgtgggtgacagagtgagaacctgtaataacaaatggaaggaaggaaggaaggaaggaaggaaggaaggaaggaaggaaggaaggaaggaaggcaggaaggcaggcaggcaggcaggcaggcaggaaggcaggaaggcaggctggctggacggaaagagggaagcagggagggagggagaaaggtacatcatagttattatgaggattcaatgaaataatcctttgttgggtgccaactggcaagatgaattcagttttccattgcataaaaagaatcggggggtaggcagagctcctcctgaggcccatctcttacctcaacaggtggcctgccaacctccccttaggtcccacacgcctaggaccttgagtggagtgaactgagactttagggcaaactgagggtttctttagaaagtccaaggaaagagtgatcacttctgggtcccggtactgcatgggtgccagttgaggaagctttggtggtaggatccggccagaggagctaacgcaggaaaggagtttggggtggaaaaacttcgtaagctaggaggtcctatgatgtagtggataagaacaggagtgtatgtatataattttatattgtagaaaattgaaagcatacacaaaagtagaaaaaatgttccctaatgcatctgtcacccagtttcaatgattgtcaccacatagcccatctttttctttttaacaatacacctcactccaccacaaatccattccacccccaacacaaacacctatccctggattatttggaagaaaatctcatgtaattttaactgtaagtatttcattatgcatgtctgaaatgtaaggacacagtaaaaaataaacattacaataccattatcatacctataataactagcaataattccttaaaatcatcaaagatacctagtcagcagagcccaggcttttaatctagccaaatcactgttccagtcttccttctacagcatcaatagcctgtctcagagcctgttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagcatctcctgctctgggacagttacagactgttggctttagcagtgatttggagagtttgtgcttgctttggctgggaaagagacttatccatagcctactgcctttcaggattcttttctaaggggatatcaatgcctgctctccacgtctattttctcgaggcccacagtggagcacaaacaatggaaacataggaatccatgcagagggctttagcgatctcctgggacactgcttctgtcctgtcttttagcccttatagtttatagtttagattttacatgtgtttcctatcttttcaaccttttctaataagaattccttacatgtggatgggacttggcaaccagcaaatctcaccttagtgtagttgttgaggatgggttcagggattttctagaaaataaatctattttctaggtttatttcctggctgggccactcctgtgtgtgtgtgtgtgtgtgtgtgtgtgtgtgtgtgtgtgtgtgtgtgtgtgtggtgttggtgggaagaacataaggttcttcatggagtgggtgttcaatatatgactgattgaagagaaggtcaatttgtaggtcaactaggtggtgctgaaagaattgagcaactcccatttgtgccttatgccacatgcactgtacataactgtgtcttggtctccaaactaggccagaggtcaactgtaacttgggccaaaggtgccttctgtttccagttttgagcaagggaatggcagctctccatatggagcagggaccagggggtgctgttggcagatgcatggtgagagctgtcctgaggaagtaccatccagagtctcgtcctagcaaggtgttttagtgtggttaaagggtcactcctggccgggtgtggtggctcatgcctgtaatcccagcactttgagaggctgaggcgggcagatcacctgaggttggcagttcgagaccagcctgaccaacatggagaaaccccgtctgtactaaaaatacaaaaattagccgagtatggtggctcatgcctgtaatcccagctactcgggaggctgaggcaggagaatctcttgaacctgggaggcggaggttgtggtgagccaagatcgcaccattgcactccagcctgggcaacaagagcaaaactccgtctcaaacaaaacaaaacaaaacaaaacaaaacaaccacaactcaactcctgcttccaaagatggaagtgagagaagattctttttcctttaactgagtgggcccttagttgagatatacagacatgttttaatttcactaactcggccccacagtgtaggagggggaaaggaacagcaagtagtccaggtagaggaagagctagggtccccacactctagccagaattgggggagctccaccttctctgatcaggggagagacaggattcccatcacctccttccaataactaaaataaccacagcacaaatatgtgtcctgtatcagcaagctgccattgaaagagggccatggaccctgcgtatgatagagcatgctaggtgcactcatggtccttataaaagcagccaggtatgcatgggctgggccctgcatgcacaagttacccattggtccactaaacgtatgttcctaaaacccattatggtcttaagaattcagactggcatggatgcaaaaattcagataacccctaagtaataaaagtacttatttttctttagaacctaagacctataagtctcaactaatttgaagaatactctggtgaccaaagggagaatgcctcttcaaaagattgcttttatttggaggttgcaggccttgcatagggtcgttcccccagcccccggggactctgttaatgaaggggtttgggtagggcttgagcctctgctccttcaacatttcagcatacacacaaaagagcctacttctcagcacagatgtgactactatgtgtccacttggatgtcacatttcagggaaggttcattcataatacaggtaaaatgttactatattttatcctctgttgttgctttgaaaagtcagtggtcagcctttttactcctttgaaagtaatcttttcaggtcacttttgaggtttttttgtttctttttgtttggtgttctgcaattttgctatatgtttcagtattgatttgttctttcttattctgtttgggagcctttgggcttctggtgtgtgggtatatatcattcatcaggtttcagaacattctcagctgttataacttcaaactctgcctctgttccattctattcttctgggaccacattttagagatatgttagtccatcttactgtgtcttcttatctcttaatctttctttgatattttctaatttgtcttactgtattgcactttggctaatttcttcagctgtatattccagtttattatttatctctttagttagttctatccattgagtttttatttcagttattatatttttaatttttttcaaacatacaaaacagtctgtaggtaataattttattatctgcagtctttaaatttctgttttcaggattcctggcttgtttccttgtgtatttaagttttctttattttaaatattattatttttgttgctttactgtaagttgcttattttccttgggattttatttatgggtagtttttgactcctggtttcctgtagaaaggatctgtcttcattcttgctaggcacctgagagctgccagtctggaatcatgctaaatgaattctgacctcaggttttttgattacccaagtagtatacattcacttttcaaatacacatgatggctggcttgccgttccaagtttttattggagataacctagttcctttccctgctactccaactcagtgtaaagattgagagtagattttccttatcgtcctagggggcaggagtaatttgtatttctagtacacgtttacactgaagtgtagctttttggggtcccagctttatgagagttatctcctatcagactctttttgggatatcttgacctttgtcccccatcccttatgccctgtgaagctatgagaaatcaaagctcaagttcagctggcttagcaaatctactttgggtgaaaattggatgccgtatcccacttatgtctctgggttcccactttcactttttttctggctagaaaattccttgtgtatttgacagttcatagattgaaaaataaaacaattttaaaaatattttatccaggacttttggatgttttcagtggtagatttgtttaagaactagctttttatatgctcagaaatgaacatctggatcttgttttccaacacttttatggctgtgtccttactttcaggagcaaccaggaggacattctaattctattccttggttgtcagtgctctcctgaaatatctctaaataagttgataaatacctactgtgtgtctagtattgtgctaagttctatgaaatatcgggaagaccatgtagcttctcatgtagctaacagaacattggcagtagtggccttcagcccttggaacactgatttaaaccatattttcatttccaaacccttttaagccctagaaattagcatttagaatgatgtggttgtaagactgtaaggtacataaaggcagaggccatttgtatcttgtttataatagttggcacatagtagatgctcaataaatactgaatgaatgagtatctgggaggtcatggaggcagattccaatgctgatcagttcccatggcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacatgtaggtagtataagtcggtgattaagaacatggactctgaagtcagactgcccattttcatcctggctctgtaagttacgttgggtcagttacttaacctctttgtgtctcagttttcttaggttctacctatagagttgtaggaattagctactacatactaagtattaagacaatgcctggcagagaagtgccatgtactaacaattacttattatttctattattattatctccgttgttgttttgaacaccagtcacatcataaaaaatacattctcctgggagttatttgtcatttctatatgaaaatattctgagttttcatacttaccccttaggattttggagcctgccctactggagtatttctccaggtaggggttgaatacctctgtatctttttttttttttttagggaaatatattaaaatacaggatgctgggccccatcccagttggtccaaagaaatttctttctctgaaactctgtgatgaaaataaagattctacacattctctgtgtgttgggttagccaggaactgctgcaggtttaagtttaccatccttcagtgctgatggaaaatctgggagcaggcttggagcctgagaagaaatagagaattggagagttaaacagaagagaagagaagaaagaaagaaatagaaagaagtgaccagagtgtactcatgtcaggaggtggtcaaatcccatccatctctggtggcctccaggggatatgtgacatttgctttcccttgatttagggatttatgaacctggctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggtagtacctatattatggcagctaggtagcgtaagtccttccgttttcatagtagactttatttcttttccatcagggagcagcctgaagtatggaacagacaataatggttaagatgatgggttcttgagccaggttccctgggttcaaatgccggctgagccacttaataaacccaagaccataggcaaattatttcactgaaaccctatccctttttcttttaaaatggaccttggatacacataattggagtaatcatatttctaatccttgactcatttcatgctgcaccattcgtccatgtatagcctgctttaattttatttatgtgtgcatttacttttttatggataatatgacaactgtgagcccaacttaagaattagccacattgatgagaactcagtctgcctgtgtgctgctcccccaatcctgctctctacctccctctccaccctgaaggaatcgctggcctgaattttggttattattctttttctctttttgaagttttatctctctcatatgcacagagatatttatattcatattgatgtagctatggatatatagatatatacatgtagatatatcttcctaaataagatattacttggttgtttttctggccctcataaaaagggtattatgttttaggtagttttctggtacttgcttgttttactcatcattatattagtatgattcattcctgccacagagtataactgtagttacaatttcactgtggcataacatttcatgttaatataccacaatgtatttctccagtctccttgagatgggtttttggtcatttccagtattttactatcatgaaaaattcctctgttcctcagttttctcatcttcaaattggggaataaccataggagctaccacataagggtgttatgaagataaaaggagttaaagtgcttagaacaagaccttgctcatagcatattgttggtccgtgtattggtttgttagggctgctatgacaaatatcacagactgggtggcttaaaaaacagaaatttatttcctcacagttctggaggctagaattctaaactcaaggttttggcagggttggtttcttctgagggcctctcttttccactggtgagtggctatcttctcccaatgtctttgtagggttttttcctctgtgtctgtctgtgttgtaatctcttcttctttattgtttttttctttttagttggagtcttgctctgtcacccaggctggagtgtaatggcacgatcttagctcacagcaacctccacctcccaggttcaagcaattctcctgcctcagcctcccgagtagctgagattgcaggcacctgccaccacacctggctaatttttgtacttttagtagagacagggtttcaccatattggccagcctagtcttgaactcctgacctcaggtgatccacatgcctcagcctcccaaagtgctgggattacaggcatgagccaccgcgccctggactgtaatctcttcttatgaggacactggtcatattggattaggacccacccatatgacctcattttaccctaattaccttttttaaaggcactatctccaaatacattcacatactgaggtattgagggtgaggaattcaatgcatgaatttggggagagacacaattcaggccataagagtcagtaagtattcattatgaccatcattctcttcaccctcctccttatcattaaagctcaagaaaatgcagcagacttagttatgatatatcccctaggaacactattatgtgaactattattattatccttaggcagaccaaacaccagagcttccttcccggccttttcagaaatgactttggatacttggataccagcaacaagtactcaaaaatggtaaattgtggtttcttaagatgataggcagcagctccttaagtcagttagatgtgggaggaggagagtgaggaggtttcatttccatcttggttaaaagaaacagctaagtgagctcttgtagagtatctaatggtatacagactcgaaattgccacttggtaaagttctatgggttttcctgaaagaggcaggcagatctggtttttcaaaccaggaaatacacttgcacaagtggctgtgccaccagaacaaacagcatcttttatgggctcaaagtatttgacattagggagctggctaggggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaaaaaaaaaaaaaaaaaaaaaaaaaggaccagtggctgcccccccgcttaattatgcccccctgccctttccatgtcagacgatgaaaattagatggaatagcatgtgcctggcagggctgtgggcatctgtccttactggaggtgaggtgaggagtgggagtagggtctcgagggaaaaatacaatgagaacaagggatttgggggtctatggatgccccctttacacattattttcttaacaggctgtgattctccaaaggagggaattcttaaaaactagaacaaattaacactaatcatcattaataatttaatgcatcctcttggataaggattcctgtaatgtagagatgtaaagaatgtaacataaaagttcccacctcctactccccagagagaattgctgttaacagtttggtgtacttatcttttaacttttttcatcctttaaaagaatttagctacatgattaaaaatgaatacattcatttgttataaaaaatatatatatacaagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaaaaaaatcaggatccagtgaagtttcaagtattgcttttgattattccatctctttactggttttcatttttttaacctaagaacggtacccccttcttcatttatgatactgaaatttagggagttattttgtagaatgtcccacattctggatttgaatgtttccttaatgacaccttcttatttttaatggcaatgtggtattctgtaccatgaattcatcgtggtttttttaactagtcccctattgatggtcatttaggtcgtggcattccttttgtggctcctctcacaagtggtatttcgtcctaaggagtttgtggccccagtaggccacagttaaagtctgtggtcagttaatgaagataaagtgttccaaaacctaacttcgctggcaggaacattatcaagggcagttgtaaactgtgaattgcatcctttcccctctaaaggagatggattatcttttttgattccctgatttattttgagaggctgtagtctagggctgagctgagaccagggttctgtctttgtaactacctattctcacttggcacctgatcattaaccatggactcttctggtaaggccaagtcacctgaggtatggtgtgagctcccttaatttgcagtgtgcagccctccctcaagcagttattctcacttcagcctgttcttccttcctcatctcctgggatcccaaagctaatatttccatctgtgctttgggtcctattccctcccacctgcttccagtcctctcgctgtctagtgcctcctgccccttatgcttctccagcatctccctgtccactggctccttccttcagtctatacagaatctctcctgttcttaacagttatttctcaatattgataccaccctttagttatagttttcatctctctccaggcatttactcttctcaaaagattactgaggaccaggggtccaccaaatggggtgcaagagatgttccattgggtgtgtgaagaaaatgttagatttctattctaataaaatttcatccttttaaatttccatgtttgtgtgtcctgatgtacatttaggtgtgcatattttataatttacagttatacatgtatatcatttgccttactttcgattcttatcatcctctctagcccccttcagatccacacccacctacattctcaccgatttatgagcttctctcccaggcagtcacactggcatcacaaattcagcatggccccagcttcttttcttgtacctcacctcctccaatctgcaccctagactgtaggtcccaacatagggagaagccccaacatcccaccatccatctaagccatagcctgtgagtcatcttcaacttcttatcttctcttacttctgcacaataccctgtccagtcaattaattagtcctggcaattcaacttccttaccttctctcaaatctgcccatcctctcttctctcgctgtgtctgcctttgtttaggcattgctatcgccagcccctaactggtccctctgcctcaagtagcaaaccctgcacacaaccaccaaaaggagctctgcaaaactacataccatgcatgcctctcactcacttagaaaattcaaaccaaagccaatacatgatctacagggcctcccatgatcttttcctgcactgatattcttgccttatctgttagcctcctcaactagactatgaactgttgtagggcaggggtccctaccctgcaagatgtcttcattattgccacatagcaagaggcaagcacattacctgtcacctaggcgtgccttaataggtgtttttggtcaacagtatgaaagtgagaataggactgttttgggtaagaacaggagagtggagttgaccttcctttgagaaataaagaagtttccagtgagaaactctggcctatagataggccaaatgaatggactgatgtggggagctaaagttaccctggtagtcatctgataaacatactaatgtgtgacttaggactgtgggacaggcccaggtgataccatctcttcttgctaaggcagaatgatgaaatgaaaccccagcttttgacctagaaagatgtggcattaagtcttactgcctgggatggaaattctggctttcctggttactggctggattgatgttgaaaagggggatagtgattataacagccagcatttaatgagtacttactatatgccagcactgggccaaggattctacaggtattatttcaccacaactggatgaagtagatactgttattcccatttatgaataagtcaactgaggctcagcaaaattaaatgatttgcccaaagttgtatagagaataaatgatggagacagaatttcaatctcagcagcctgactccaggctggagataccgattgggagtcatcagtatacagatggtatctagagccaggaacctggataagattacctagtgagtgggagtagctatagaagaggaacatggaattggttcttggcccctgtagtatttagagatgagggacataggggaaattcagcaaaggagattgagaaggaacgccattgaggtagagaaagaacagagggtgatgtgcgagaatcccagcacagaaagtctattcaggatgagggaatgatcaactgcatcaaatactgttgatggaccaagtaagatgagacctgaaaatagaccaggactagtatttctagttgtgcaggttgttaattgcataatggagtgagtggtatctagaatctctctgacaccctggcatggggttgagccttggcagaagaaggagagcctatttcacataaagacgccatgtgggctaacttccatccttgtgttgcctactggaattagaaacatggaggtcattggtaacctcaacaaaagcaatttgagtgaaatggtaggaatgaaaatgtgattgaattggatggaagaatacttcagaggaaaggcagtgatggcgatgagtagagacatctctggaggagttttgctgtaaagtataaaggaaagcagagaaatagaggtggaagctccattactaccacaaatggaagtgaggtcaagagcttttgtttctttagatgaaaggtattttagcatgtttgttttctgatagcaatgatccagtgagaaaaacagacaattgctggtatgacattcttgagtaggtgagaaaggataggatctagtacaggagtgatggtactagccttagccagcagcacaggtgcttcctgcatagtagcagaggaaaaagcagctgtggggatgggtgcagggaggagggaggtatggaggtgggagcttatgcatgttatcttctaatggctctccatgccccctcacctcactgaaataggaaaccatttcctcagctgagagcgaggatggggaaggtctgaggaaagcaggagaagttgtgaaatagtggcctgggagagaggagagtaaatggtcttgggaatatagtgagattgtagagcagcatgaaagtctggcactaagtttgttgtcatgaatgtaaagggttaatagcatggctttatatttttctccagacatgtttgcttgcatgggtttagggatgtgaagtcagacagttggatttagccaggaatgtggtattgcaaggtaagtaggacaaaaagagagagtgtgtcaggagagttgggaatgtactgaaggaagtgatgggccttgaactcaatgctggtgagcatagaagtgaggacatgaggttggtgagggggcagtaaaaaggtggtaggatcaagactgtaggtcctggtgaagtgggaaaattgtgagagtagggatattagagggagtgaattggccagacacaaggtggtggctggatagtagggtgcatgacagaggttatggagagatcacagccattaacagtaactggtgtgaccatgtgaaaaaggtgtgaggtaaaatggagaggagaccttgaggagcatggagggcaaggcattgagaggccagggtgttgctaaatattgataccgcagagattttgacaaaggaatgttggaaaggcatcacagggaggggaaaggcaaaaccttcaaggactgaagaagggagggtatacatggagggggccgtaaatccgtaaatgactgcaacagaaaggagtagtgggtgccatagtctcaggacatgagattcaaatcagcagagtggttagcaaggaggcagagagaatggtctggaagagacagcaatttagaaacatctgtgaggcacagagaggcactcccttggcccagttgtgtaaggttatatgagaagaaaaacccccactacttgagagagctgtcaggatagcagtgtcttcagagaggaagaactaagtttttcttaaagaaaaaaggtgaagggactgctcaggtgactgatgtaaacagggaagtaggggcgtggtgggatcagtggtctccatggcagaggacagtggtgtagctgtcagggttgtagagtgggaggaaggaggttgagattctttccacgaacagagtccacgcacctactgtttcagacagtctaaactctagagccctagagaactttaccactctggtcttttgattctaaaaaggatgttgacttgtgagaaggtagttaatgacctgtgttgcttaaagcatttttattacttttgactttaaattgcattgatgcaggactttttgtctataacctcaggattcctccagctgaaaaagaaccaggctatgtatattagagtggaattccaggtatgagttctctagtgtgtagaaatgaattaaccaagtggaactctttctagggaagtatggcatttcacagatattacttgtaaaatggggaaaagagggtcaggggaggctcgctgagaaagttcccagaactcagcccagactcggtgctcagtaaagaactgtcttagctgggcatcatggtgcatgcctatagtcccagctacttgggaggttaaggcaggaggattgcttgagcccaggagctcagggctgtagcatgccatgattgtgcatgagaatagccactgtactgcagcctgggtgacataatgagaccctatttctttaaaaacaaaaacaaaaactttttcctccattattgattgccctttccccctgtccctgtgcctattgctgtttctttggatgttatttaatttctctgtgccttagtttcctgtatgtcagatgcgcatgatcatagtccctacttcataggaaagttgtaataattaaatgagataacactatgtgtattagtccgttttcatgctgctgataaagacatacacaagactgggtaacttataaagaaaaagaggtttaatggactcacagttccatgtagctggggaggcctcacaatcatggcagaaggtgaaaagcacgtcttacatggtggcaggcaagagagaatgagagccaagtgaaaggggaaaccccttataaaaccatcagatctcatgagacttattcactaccaccagaacagtatggaggaaaatgcccccatgattcagttatctcccactgggtccctcccacagcacgtgggaattatgggaggtacaattcaagataagatttgggtggggtcacagccaaaacatatcaacgtatagaaatatttaacacagtacatggtacataatataagtacttaaatatgatttgctattaaatgacaagtggtaagttcttggctcccattcaactctcttattcttgccattatgtttcttcttacttcaccccctttctcttacatcttcttccctttctctccttctttttccacacttcctccttaacctatttcctctttccctcccctggctttggttgcagtggcatatgcacctagttcagtactctttgtggccccctgaagtagagaagtcttagagtaggggtgaggcagccatcagaggaaggaaactgctggtggggacagtctcttggccattccatctgaagtctgtagtgtagccatggtggctgcagagatgcaaagggccagtgacaagaggctcaggagctgggaggcctatgttgcagggcaagtttggctactgtgtgatgtgtggctggggcaccagacagtaggcagagcatgctatgaagatgaggatcatttgaacaggaagggactgggctaaatcaccatgtggagggacgagtgaggacatgtgcatgtcctgcccctggtcctgttgctgataccactatgactactcccattcataagggtggctcctccccacggggcatctcctgtcagtcggccttctgtgggagggagcgagtgagcaaaggatagctgagtgtgctggctaagactataaattctagagccaaactgcttggatttgaatcctggctctgtcaccgaatgagaatgtatccttgagtaagttatctaacttttctgtgcctcagtgtcccatctctaaaatggatataattggaacaatacagttcttatgaggatttgtttaaattaacagtttacaaagtgattttcatagttcatggcataaaagaagtacgatgtgagtttttgttatattttaaaaattttaaaaatcatacaacaatcttagaagacttactttcattttaccgatgccaaaacggaggtggagaggttaagggccttggccaaggccacagagctaccgagcagcagagtcaaatctagaacacagctttgacatactccaaagtcctagcttgtaactgcaatgcttaactgcctccctggacattcaggtggagactttgctttctaggagagctgggaggcagggtgaggcaggtgggcaatgtgagtcaaggtgggtggtcagcagttggagtctgagaggttgggagaagtactgcttgaggacacacctgggactagtggctgcatgcccttggcccggctccttggttggggagagcagcctggcttcccaggcccatttcagggacaggtcaagtcccttaggtgcatgaaggtgctgatttcagccagagagctaagccttcttgggactttttccttccttccctattttccaggtgacctcagtgaagttaataacccttttgcacctcagtttcctcatctgtcaattgaggataatactttacctgtctgcttcctgggtattttgagacattgagtagattgtggatgtgaaatcatttgaaaagcataaagcagtacctaaatttaagatactagagtgatctcagaccacattactgtgagggtccagtgtagatctctcaggcctctccatagctaccttgtgctgataatgcccagtgtccaatttcatgaccttttccagctggggtctacagtgatacttggactcttacctccttttctcagtttttacatttcccttggtgagtgtaaagtaatagttgagcagcatgtgggtccctgggaaattattttccgtgtggatttttatttttaagagccagagccaacgtctgtgtccagcctccacagttgtcccagctcccattctgggagctctgccatcttcttggtttcagcccttggcataagacagacctgggctcctgtggctggggagcctgtaactgcctcctctcattagcagacagtcttggttatgtgcttgccctgtggggaacagggaggcagctgaccctttcccctgggtgcctttgtctgtcctggcatactttggggtgtgtgtgtgtgtgtgtgtgtgtgtgtgtacacgtgtgtgtgtatgttagagattctgtaagcccaagaggctaggcctcttgtcagctgccaaagttcttttttccccagaattgagttagccacccaactgtttccattctctgcccgctgcgaagctctacagcagggctgctgtggcaggtcaaaacatgctctgctttgagaatacagagattccattttgagagagatgggaaacaggagcgagtgagtgggtgtgttggatgtagggaaagtgaggacattctttttggtaagctgtgccaaaattggcccagaagcttggtctaaactcaaaagtagggctaatgctgggctgacacccaaatatccaatggggaaagtttattcttggatctagaccctatgagacctagcaatcatttttttttctcatctggaatatggggataattctactccatatattcttcatgtcaaatgagaaataaacttgtaaatagtctaccgtctagtctccaggagcaggaagtgacataaggttgtgattcttaaagtattttgcagaatacaaactgttactaaaaaaagaatcacttgctaaataagtttggggaacactggataaacaatggcatgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatcctcggcctggtaagtttggttatatccccttctatcccctctgtttgcagttctccataaatcttggtaatcctggttggtgctgacgtatcactttgttttgaaaatgcaagatgctaaaggccaggatgtcagattgttgtgtctggattgctgatttatgatctacagccttggcctctccaaagagttttctgagtctttcagtaatgactgtttctttcatccctggggaggcaaggatgcctttcactcatggccacttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaa

SEQ ID NO: 4913 - DNA, 174693 bp, human
gaggggcccgtcggcggcgaagttgctagctgggggcagagacggccacgcggttgcaggagtaagagatccctctgtggcgagtgcgtgagacgaggagtccggcgtccctgccatccccgtcgccctccccgcctgctcggccccgctagctcctctccttgcctccgcgtgtcccctagctctgaccccttttggctcccggttcgctgccgcagcactgccgggtctccttggcccccgccctgaccctttcggcctccggcttcccctgacccctgcttgcttcgccactgccccgttcccgttttcttccctcgctagttacccctcccgcttcctaattcccggtgcaattgcctctttgagacctcttttttttttttttcctctccttccttttagattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaagtgataagagtcatttatgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctgaaccctaggaacgactggcactcaccctggctgcccctcccttccagcccagcccaaccctgccgtgccctgggctttcacaagcaggaattccagccccagccaggtgccctttctgaatcacatcagtggaccatgacccagctcccttgccttctgtggtagttaatttcccaggggcctggtgacactctttcctggaggtggtcgcataaactttctcatctacactgtggtactttggggaaatacttttacaggtttctcttaatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataataccttgcatttatctaacaattactgtttataagatactttcatatacattgttacttttagcttaggcctggagaaagggatgttaaaatgtttcctgcaacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttacccgcttttggttcactgtttgattttcttacttcctctctccttgctaaaagtgtagaatgacacacactcagaaagtcctgagctttttgtgaaaccccttgcaactcactgaatacacactgttgcattccggttgttatgtgatgaatttgttttagagaagacctgatggatttgagaaacttggctttctgttttcccccttgacttcacaccagacacacctcctcattctccatctgttgtctggagcactgattatcattcctgcttggaattgaagttggtgggtaatgggtacaataagggatccagccatctgctgacagcttatcagatggactgcgtcctgtgtcatcagtccagggggatacaaggggatgatgtttatatgggcctcactagtgaggcatgacattcctttttagtttgtttctccccccaaggaaatttgcagagaatttttccatctttcattgttacagtcattgggggtgtccatataaagagaggtgctgtggattggtgaattaaacaacccacaggcagccccaggatttaaaattatgatgctagttttgctcatggcttgctacaggaacctcagcaaactatttaaccttttcctatctcagtcttctctgtgaaacgggccacatggaaatgaagcatttgaattctctgaataattatgtggtcacttaaacagagaagctgggcaaagctggtcaaagatggcagatgaccaatacagtttcaacttcagactcagaaaccgacaaagctcaactccttatacctttcttgatagcttctagaaggcattcctctaatcatttttgttacttttctctggatccttgcctgtgtctggatacctttctgatgcatggcatataaaactggacactaactcttaccagaggtccagcctacaccaagcagagaggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcctttgacctcactttgagagatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaatgaagtgtggtgccatctttctacctttctttttcatatctcttcttccctgtttccaagtctgtccacctgatccaccccacacaagttccaaaacaatcctttctataattcaaaatgcccatctcatcagaggagatgatagccatgggggattaggaagaaagcagttttatttcagaggttcatactgaaatgtgagtggacagactccactgggcgtcagggagaggatgagttttaaaaaagggccttgttaccctaacattatatctaattggtagactgtgtctagtgtttttaagcagatgtcctttctcatgtgccttgctcaggttttggcctcttctctcccgctaaagcccctgatcaggagaactggagttatccatgccttgccaccctacatgctgacccccagggtttcatattaatgtaaatctccctccacagtgcttggatgcagcagttaatctgaaggcctggcgaggacccctcttctgggcaccagtcagtcctctgtgtttactcagctctttcctggctacacagggcagcgcttgcacatctgtcagttcatgggcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctccttttcaagactttgctctggggcctcgttttcaagactgaggtctggggcctaagccaccaatcactagagaaggatccccttaagagcagccttctggggcctagaccttgatcatgtgatttcaggccttgggatgtggggggtgtgctgtatcctgccaaggccattggaaggcctctgggcatattcccaagcattgtgggtaagaaggctgtttcttagtcttggaggtgggagaattgagaaagctaaggtcatgttttctataacctggttcctggaagaggagctggtttagagggcatttctaaacaaacagcaacccaaataaacagcagcgcttggaaattagttatgaaagttcacacattctaagacctagggaagattgtaacaaagggtcctcttcatatcagcacttgttcattgttggtttgcatttgttaagagtttccttttttaagttccaggaacttgagtgtgtgtgtgtgtgtgtgtgtgtgtgtgtgcgcgcctgtcactttattctctgcaccctgcaggaatgttgctcagagtcatgtgcacaagtgcctcattatcagcagcgctttcacacttggtcccttgggctgccactgctactggctgctgcttcatgtgggtatttctacctatttcctggagccccagccccacagggaatgttggcaccctgaggaaagggaccgcctctacatttggatctcccttctgctgcagggcagctgactttactctgctttcaagttcacctttcctcagaatagccctgcaagctagcaccaagccaaggttatgtttccttgcttgcatgtggggtttctggccagtcagccaagtgaactgattgacccccagccctgtggggaatttcaggggggtattgtcttggtcatcggagtcaggggtggcctttaggccaaggctgcattagctttgtggagaagaatgtgaagcccgccgtgtcacagggtctgctgaccggctgggtagtgtttggccatatctcacagccagtgctgtgtttgctcagatggacgcacatggaaaccaggctaggatcatcttcccaaatgtcttactccctgctttgggtctgtcctgaaaaacaatttgcaaagtacattgtggtctgcacctgttgttttttcatcccccttttccacagtcagtttgcagtgaatggaggattaatcctggctcttgccacttgtattttctctttcccttctttccttgacgttgggttcttgcttttcagttataactgtctgtggacattaaggacagctggtgcccctgatcatttaggacctcccttaggcctttaaaacgctggaaatgtgtaacagggccggatgggcaaaaaagagtcgaatttaggagaaaactcactataatttctggttatctttgtacactctcagaaaagtgaggagtggtagtaataacacttgtaacatttttgaatacacgttaattatgctttaggcatggtgcttagtctactgcctgtgtattacctcatttgcagccttccagaaaggttgttttttgtttcatgtaattttttgtttttttgaaacaacgtcttgctctgttgctcaggctggagtgtagtggtatgaatatggctcactgcagccttgaccccttgggctcaagcgatcctcttgactcagcctcccaagtagctggaaccacaggcacgcatcaccacgcccagctaatgtttttgttttttgtagagatggggtcttgccatgttgcttaggctggtcttgaattcctgggctcaagcgattcttctgcatcagcctcccaaagtgctgggattataggagtgagccaccacacctggcctgttttatctaattcttcttttctttgcttctagctgatttcccctttggtagactataggcactggatgttctagctgtactttctcaggttgttaaaatggcagagtgataccaaatcagagctgaaagaaacctctgagaacaactaatttgtttctttttcatcccttgttttccagatgagcaaactgagacccagagaggtgaagtgatttgcccaaagtcacacagctaaatagaagcagagctgagtctcctgactcccatttcaatatctctctataataccacacatggcctccttctatccttaaccttccagcatgaaaggaactagacttttcttcttgctcactattagagaaatggaaatcttgtgctttttgagcatcattgtttattgccttcttgaaagtgaggatctcctggctgcaggccacctccttcctttctttctttctttctttctttctttctttctttctttctctctctctctctctctttctttccttccctccctccctccctccctccctccctccctccctccctccttccttccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactctatctactactcgaccctttacactactgccagaatgatacaagtaaaatacatgttggatcatgccattcccttcctccaaaacctttgataactccttaatgccttcatcagggatggtaaacacatagatgcatacactttatattgtccctggccgactgtgctaatcaatcataggcacgctttcccagggagagtccaagtagatttaaaatctgtttagcatagcattctaggtagccacttatcaatcagtcagagctggtattaatatatagactagggatggcacatagataaagcctgtagagaaatcttaatctccttatgataggattcggtatcttctgtgattttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgtgtgtgtgtgtgtgtgtattgagtgatatctcaatatagttatttcctcctctttattcccaaagccttgggagtggactgcttgtaaagtgttggtcccatagcctgctagttagttgtttacttgtcaagagagatctaagatgtaagattctcaataatagtaactacctttattgggccttttcagggataggttttcagacttactctgaatcatacagcttgtaggatgggtgccagcactaggacccatatctgccccttttgagcagagtgcctggcatataggtatttgatcattgtcacatgatgtgacaaggagctttgtttctttgtgcaatgcttctttttattaaaaaacccagcggtggtaaaatctgacgtatttgaaaagtctggtgggagagaggtttgaggagaactgcctggcattcaaaaagcttatgatatgttagatagtgtgtggtgaatctagatcacataacatgtattaagcaattactccaggcctagtcgtactagagagatacaaaagtattagatgtggtttctgcccccagggaacttattatcaaggctcattaacagtctgactactgtattttcaggtggcaagtatgtacagaatttatgaccagaaaatgctagagatcagagaggctttcaagttcctgaagttcaagcccgtcgttttgcagatagagaaagaagcccagagcagaaagctgcttgctgaaggtcacaccacttgggaatggcagagccagggctggtgtatatggccttaccctttgaggtcctattacactctgttctgtcgcccttgaaggacaggtgaacctaatggcctgtgttaaaactttaacgatatgctttatgcctccaggcctccttatggtttgggggaggggaggttaaattttagtctttcttaaaaccttgagtgggaagggccagcactggttacctctggctcaagcccaagagttctaaagatggctaattttccctttactgagacaaccactgattctagtctaattagggcactttcctactcctcctaagggtctttcccaagctcagtgtgtttatgacttttctacttcagttcctcatttttttttttcctttttgtgaaactcaccttaaagacaagaggtgcctgtccttatgggtgggcctgagagttagaggagtggggccagttcctagtgatactagcatcaggctggttcttttggccttgtcccctgctacttcccaagccagaaatttagatccaagtttggggctttctcagaaggttcaggtataattcaaggtagaggtattcttccttccagacccctctccccacacagttagtattagggtataattctagtcaccactaacatctattgaacgcttaccaagtgccaggcatcctgtggaatagatgctattatttgcattcccattttatagataagaaaaataagggtcagggaggttacgtaacatacccaaggtcacacagctagaaagtgaccaagctggtatggatgtgtagatctggctgactcgttactgttaggctaatggagcctaacatgaaaataagttactaattatatttttgtattgacgaagaaccatttgccaattttctgcaagccaatttaaagaactggttgaaagagaagcatcctacctatagttctgttccactgtggggtggactgtatcaagaggcttgccagtcacctgcatttgtcaagtaagtcccttcccttctctgagattcagtttctgcctctgtaaatgagagggtcagaccagatggtatctaagaccttttctggcttcatttgctacttcctggtagaatggaaaaattgtagaattggatgaaggacacaatgcattagaaacacaaatgtggagagaatacatagttcatcacggatgggttagttagccagttacacactgtttctgttttcccttgtgaatttataatgaaacattttttttttcttttcagtgagcttcttgctaacatcagaaagtactagctttccttttttgttgtttggttcttttgtttgttggagacagggtcttgttctatcactcaggctagatgcagtggtgtaattacagctcaactgtaacctcgaactcttggactcaagagttcttccacctcagcctctcgagtaactaggaccacaggcacatgccatcgcacctggctgatttttaaattttttgtagagacagggtctcactgtgttgcccaggctggtctcgaacttctagcctcacgtgatcctcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttttgtttgtttgtttttgtttttaatgttgctcagtcatgccacgaaatgggtacctcctaaacactaacttggataccctgctggtttgctgcctttcagttttctattcacataattattgtttgcattcccattctaattttggcctctggtctcagtaagaaggagaattgaaatactcagtgtcacactcattacacccacgaccctcattcatttcacaaactaacctcctgtatttcttctcttcttctggcttggcatagggcttttgacttagatctgagctcaaagctaatttctattactcatgagctgtgtgcctttaggcaagtcacccaatcactgtcattatgtttttcatttgtaaaatggagctaaaaattctatctacctcttcaagttatttagagaattatgtgagttaatatttctaaagctctgggaacactgtgtggtacatattaggtattcaaaaaatattagttacagtcttcctccttgctccccaagaaatagagccagtaacaacaacctttcttctaatacctcatgaacttctcctggcattagctgtctgaaggggctgaggtttgccttttcttttgacgatggagattagtcattagaaactctggatttcatcctcacaggaaacttgaagttgttgacttttgttccttgttaaagagttggtacgactggggcggaaatctccagagaaaagggcgtgttcctctactaattactctgtagacggcagagggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcaccttgatcatgatatattatcttttttattgttcctggatatggtttgctagtattttacatggtattcttaaacactgtgagtgggctgggcgcagtggctcacatgcctgtaatcctagcactttgggaggccaaggcgggtggatcacctgaggtcaggagttcgagaccagcctgaccaatatggtgaaaccccatctctactaaaaatacaaaaattagctgggcgtggtggtgtgtacctgtagtcctagctactcgggaggctgagacaggagaattgcttgaatccgggaggtggagattgcagtgagccgaggtcatgccactgcactccagcctgggcgacagagcaagactccgtctcaaaaaaaataaaaataaaaataaataaataaataaaataaaataaatctgtgagtgaatctggctctagttttcacttttcatactgcctttgtcaggttttcttattaagtttgtgctagcttcataaaatggattggccaatgctgcttcctcttcttctaagctttggaaaagtttgcatgagatcagagtgatttgtttcttaaaggtttgttagaacttgcctataaaactatctgggctttgatattgtctttgtgggaagattatggactactgattcaatttctttaatggttataggaattttcagacattgtatttttctttagtcagtgtctttaatttatgttttgctaggaatttgaccattttgtctaaattttcaaatttattggtttaaaattgttaatagcgtcttaactataaacactacagatatttaaaagatttcttccttttctctcatactattatttgctactaaaaaatcaatctcactagtagtttgtaagttttatttatcttttataggaaataattgagactttgttgatggaactgttacatgtttgttttctattttgttaattgctgcttattttaaaaatctgttttctccttcatattttctttggagttatgtctcttgttcttttcctaacttaggtgggatgcttagcttatttatttttagactttcttatttgactatatgaattaaaaggttaataatttttgctacctactgtttagctacattccactaattttgatataacattttgttattgctcagttccaagtattttggaatttccattgtgctttcttaactcatgggttgtttagaaggattaacagttttttcctaaatgttttaaaagtcatctttttgttgctgatttctaacttaataacattgtgatcagagaatgtgatctgtatgttctgtttctttgaattttgttgagatttgttttgtggcccagtatgatacagtgtccactagatcaaccttgttaattttgctgctcttcaatcaccttaccttattttttctctgcttaatctatcagttactgggagattttttaaagtttaccaccacagaggtagatttgtctatttcttcttttagtactgttaacctttactttatatatttttgaggttgtgttattaggtatagtatgttaatttttgcatttattgttacatctattgatcaaaatgttcaatataggggtcccgtggcaacttagagtgtggatagatctacatgctataagggtggcttggtaatggtgaaagcatccctctgggtgggctgggtaaattggattttcagctccagggaagaaacacccttaaaatcaaaattgcaccttcttgaagagttcttaaatttgacattgccaaacaaaattaacaccctcatatcctcaagtgccagaggcttttgtcgttattgaaaacactcttaaaagctgcattccttctgggatgcatgaggggttgggaaggaaagctttatttttcatgggccttacagacattacttctggttggtcagacatgtttcagacccttggactttcttcttcttactgcctagtattttctatgagacttgagccaaatcctgttacctctctgccttttaggttcaatgactggttcccttttcccctgacagaagtgaggtgtggagaaattgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgccatttaaaagatagtacattcactgggtgcagtggctcacacctgtaatcccagcacttttggaggccgaggcgggcagatcacaggattttgagactagcctgaccaaaatggcgaaaccccatctctactaaaaatacaaaaattagccaggtgtggtggtgggcgcctgtaatcccagatactagggaggctgaggcagtagaattgcttgaacccaggggacggaggttgcagtgagctgagatcgcgccactgcactccagcctgggcgacagagcaagactctgtctcaaaaaaaaaaaaaaagaaaaagaaaaaagaaaaggtagtacattcttttcaaaaggaactattatgatacattgtgtcttataatttttaaaaattttaaaattttttattatactttcagttctgggatacatgtgcagaacgtgtaggtttgttacataggtatacatgtgccatggtggtttgctgcacccatcaaccctttgtctacattaagtatttctcctaatgttatccctcctcttcccctgcaactgccgacaggccccggcatgtgatgttcccttccctgtgcccatatgttctcattgtttgactcccacttatgagtgagaacatgaggtgttcggttttctgttcctatgttaatttgctgagaatgatggtttccagcttcatccatgtccctgtaaaggacattaactgattgttttttatggctgcatagtattccatggtgtatatgtgccacattttctttatccagtctatcattgatgggcatttgggttttaacattttttaaagagttgaggtctcactctatcactcaggcttgagtgcagcagcacgatcagggctcactgcagcctcaaactctggtgctcaagctatctacccacttcagctttccaagtagctgggactacagatgcacaccactatgtccagctaatgttttatatattttttaagagatgggggtctcactatgttgcccaggctggtctcaaactcctggccttaagtgatcctcctgcctcaacctcccaaagtgctagaattacaggcatgagctgcagtgcccttccctagtcctcctttttataataattttaaaaaggtttttttgcttattgttattatttttaattaatccataatattttatatatttttgaagtacagtgtgagattttgatacacgtatccattaaccaatgtctccctaatccctcctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttctaccctcctcggaaacttctagtgctctcagttacttacaaaataaaatccagaattggtgagctgttccttaaggctcttcatgatgtggaaatagacctcttagaaaaaggttgcaaaagcaatgcatactcattatagaaaatttggaaactaaagaatttggcaaactttttctgtaaagggccagatagtaaatgttttaggctttgtgaaccatgctgtgtctgccacaactactcaactctgctattgaagcacaaaagcagctacagataatgccagtatgtgagtgaatgtgtgtggcagtgttctactaaaactatatacaaatcagtcagtgggccacgtttggttcgcgggttattgtttgctgaacactgctatagaaaataaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctcaatcctatctgtattcatgtacctgtctgtggagtcctccctagttcctcctactcgatatgatctcttgcctttgaatccctgtagcactgtgtacctctcttgtggtatttatgtctttctgcccctttttttggttatctctgtactggctttatgcctatggcatggacactgggtaatgttatctttgcattgactcccagagcctagtagagagcttagtgtacaatgggctgattagcctatcagagctatgttgaaaggtgcctaaggtctgctgcagatgacctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaagctgggtatgtatagtgacccacagtaacattgacattgtagttttctggaattttggagaggcagtctagaccctggtagagccgtagagagagagagagagaggggaagccataagtttggttcaaaatggaaactgattccagcgggaggtgtatgttgtgagaaaagggagatgatgccagattggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacaggcgtgagccaccgcgcccggcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcctcccttttgggaaaacatgctccatttaaatcatacgtagtaagtcttcagaaaccctgaccctggaggggctttgggacacaactgacaattaaatctcctggtgtcaggagatcttgcaactgagaactgagtgccccttccacctcactcataattgacaggggccagtgccttgtgtgggcctcacctcacctggcatcaccactcctcacccaaccttacctcaccttaccccaccttaccccaccatacctcacctcaccttctctcctgctcttgagagacaactaggtaactgtgagtagcacttctcccttggcatagtgaagcagcttcctcactgatgctcaattcaaggaaagagaaaagttcttgtcttgagttaccatggggcgggggggaaggggaattttttttaaaaaactactttgagcttcacacttaagatttttacaaaaatcaattatatttggtttctcttttgatcatgaaggtggtatagtttaagggttgaggcatggatactactggaatcagacactagtggactagaattttggttctatcacttgctagctgtttgaacttggggaagtttcttaatttctttgaacctcagtttacttgtctgtaaaatggggataataatgcttgccttgcatggttgttgtaaagattagagagtgtctgtacagcatgattcctgggacccagtaaggactcaataaaaggtagttgttattattaaagcaggtcatttatgtttgtaacaaccacagggttaagctcattgtcccaatatccttttatctcatccctcagcatgcttgcttttgccttcctgaagctgaagatatttatcctcagggcaagagacattgggtgtgagggatttaaggagacagattttcttgacagagggattcttaggtcaagatgagtaaggaaaactcgagagctggatgagtaaggaaaactcgagagcggcctttgccaaggaaatctaaagcaattgccaccctgttggagaggtttctgtcctgtctgaaggtaggaatgggggatagatggatgaatggatgacagccttctgctagccttttgaagagtacattcccaggaaaatagcctctactttctgcagtgtgggagtgagggcgggggatggatattgtttttgagtgaaggaaaccttgtgttccatacttaagcatcatgttcccccaccctgggatgctctgttggcctgatttaaggaaagctttccagttgatcttttaatcttcagaaataacaccagaaatcagttatgccatcactttccttataaaactaactagctttcatttagcagattttgttctagggattcagtgtgtctggatattgaatttttgtactgccggggcaaggttttctgagagtggtatgtttgatgtgtgtggataaggggttgggggtggctcagagggtgagggtgtggagcattgtcttcaaaatccctgagcaaggctgagggtgtttccatgtctactgccctaatgaggattctagcgaataggggcagtgctggctcattcatagatattaaaataaaatgttaagtgggcttccttctaagagtcaactctaaggcattctctccaaatttacttgtctctgttgctatctcttttgttagaatgagaagatactcttgaaaaactgtttatgatacaaatctatatgttaaatcctacttttagtgcagagaggcagcttgcaaaaagtacattccacggagagccttttagacaaactcctttggtaatgtgaattgtagcctttgaatttcttggttgttaaatcttgatttttatgtataggtttgcttcaagcagtttacctattttttacattttagtagaacgactgggtatgttccttttataaaatactcagggaaatggaaccagtgtcatggtctcccttgatctaagttcccagagacttaagacctcagagctgtagcagcaactcagcgagttccatcagcataccggttcccagcagcttttctttatctgtattttaaggagttgtatacagagtcacttttcatgatgacaagatgcagggtaatatgatttgaaaaaagaactgaatgaatcttttttttcccctctgtattttaatggaggcaaactgaatgaattctttccttagtctcttctgctggtctttgccttggttgaaacctccttttccctttgctcagccaccctctggggttacctgctgcttgggctgaagtcctaaggcttagcgacaagtaaccatgtcatgttgcctctgaggctagtgggcacagctgaacactaatatttgggccctaactttcagcttgatttgaagaaatgccactgctaaatgtcatctttttttgtggatccctatttgactgactctttggataaaacaggtgggcaggcaacaaattaagtgggaaatgtttctgtgaaacaaatccgtttaatagtgttacctcataaataagtaacaaacacaactctaccccctaacccgcactagcccatatagccagaatggaaaagtagattgtttctttgtcgcttctgttatggttttacttaaatgaattatcagatcagacccctgtttgtacagaagtttcaaaaatgtttgttgtaaattgatctgagccaatttgattttccacagttaattagattctattctggtaggtatcattaatctccaatagtcagaggtaggtaagtgctataggtttttcccccacaaccagtagattacagtgaaaggaattctgattaaattctgccacgtaactttattaataatcaggcacaagacagttatacagcctgacctgtacacccagagacattccagtactttttttgcaaaccaccatactgtgtgaagggttcaccggagatagatgtgacgatattttagcagtaggactcagcttaccttctaattagagggcacatctgagtcctccattaagtgtctggacataagatttgttgggactcctgagcctaaggtgtcattttaaaggggtgaagaatgttgggctaaccagagtcttatatccaattcatgcaaaagtgggagcaactgaatatttctaaatgatatacctgtcctgaacactagccagtttccctaatgaaatatttctagtatccattgttgtaacgaacaaacgatcagaagtacttcagagctgaggcatgtaagtgtgacttttttccccattagaaaaaagttaaggtatatttaacatacagtaaaattcacccttctaatggtacagttctgtgagttttgacaaatgcatacagttctatgaacactccagtcaagatagagaatatttccaccacccccaaagattccgctgtgccttgattgtgggattttttaagagcagctttactgagatgtaattcatataccataaaattcacctacttaaagtgtgtaattcagtggttttcatatactacatttaaaaaaattagttaaatatatacatataacatacaaaatttgccattttaagcatatttaagtgtacacttcggtagcattaatttcatttgggatgttatgcaaccaccactcctatttctagcacttttttttttttttaaatcacaccaaacagcagctctgtacacattaagcaataacttccaattcttaccttccccaggccctggtaaccactgttctactttctgtctctataaatgtgcctattctaggaacctgttatcggtggaatcatataatatttgtccttttatgtctggcttgttttacttagcaaaatgttttcaaggttgtagcatgtatcagaactttgttccttttttaagggtgagtaatattatattgtatgtatagatcacattttatttatctgtcagtggacatttaggttgtttctaccttttggctattgtgaataatgctgcagtgaatgttagcatacaagtatttgtttgagtccttgttttcagttcttttgggtatgtatatacctaggagtggaattgctgggtcatatggtaattctatgtttagctttttgaggaactgccaaactgttttccacagcaactggccactttacattcccaccagtaatgtacaagggttccaatttctacatatcctcaccagcacttgttattttctatttttaaaattatagccatcctagcagtatgaagtggtatatcattgtggttttgttttgcatttccctgatgactaatgatgttgaagtttatttcatgtgcttattagccatttgtatatcttctttggagaaatgtttgttcaagttctttgcccattttttgaaaaaactgggtttttgttgctgagttgcaggaattcttgattgtaggctttgattagaaatttcagttgctaactaatatcacccctggagtttgtattctcaattaggggtcttcagatgttaacaatggtgtgtggtaaatgtttaaagctctgatttatggcatttgccaatttccatggtcaattccaagctaccagtctgacccctcactaaggtagcaaaggagttgggaagagatgtacacaatcaactctttctagccagtgctattgggcttccagcatgcaacagaatgttaactcaccaccctatggtgtagaataaaactaacacagaggcatatttatcacagtgtctacactgaaactatttaaattaaattagacataactaaataattttcaattacaacactttagctccttcaataaaagcaagaataattatttgttgagcacatcatatgctagatgtgctccaagtattaatagatattattagtaaatagaggaggaaatgtagaataagttagtagtaggctgggacttgaagtcagactccaaagcccatgtgtttgatctctttactgcactgtcttctatcccattagtggaatttacttactgaatgttgactactataaacagagtagactactttcttctaaccccagggatgcttctgtgttactttgtaccctccagcctctctaaatcctgttcaaattggaattgaaaactaaagctgtggtggtaccacatatcaaagaactgtaaggggttaaaaatatccttttcctcgttgcaaaaaaagcatgtgttgtaagaaaaatttaagcaagcgagaaatggcaaaaatagaaagtgaaagtcccccataaacccatctgccagagataatcattattaacaactagcatttattctttcagagctttttctttacacattttttttaaaataacaatgggatgattccttataatctgagtctcttttcacttgataatatagttaggctattttccatgccagtgtgtatagctctactttattcattttaacagctttgcttcattcattttaacagctacataatatcccttgtgtgaaggaaatgtaagggattttgaagggctattttgaagaagtgatgataggtggcacatgggacaaaaaggttgaaaactactgttgggtaccaacaatagaggcactatactttccatttctccccccagaggctactataacttacctgaaaccataagacgaaaatccatgagcactgggaagagttacaggaaaactcaaactaagctagtcagggataattgagagataagactacatatcaaattccttcacatgtctttagggctttacagccctggtctttgaaactctatttggaatctttcttaatctccagtaggccctgctttgagtttgggaaacattgttttccaggaaatacaaccttttaatttcccctcatctgttcctcatcttgagagatggccaccatcatgttttcttgctgtgataatctgtcaggttttttttttgttgttgttgttgtttgtttttgagacaaggtcttgttctgtcacccaggctggagtgcagtggcgtgatcatagctcactgcaaccatgaactcctaggctgaagcaatcctcccaccacagcctcctgagtagcggggactgccaccattccttgctttttttttttttttttttttttttttttactttttttctacagatggggtctcactatattgcccaggctattttggaactcctgggctcacatgatcgtcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaactgactgaacgcttgcagagagatgggctaaaggccagtggtatcagtttatcaggatttgtctgccttacactctcttatccttccctctttaccccagggagctggcagaatggtgtttcctctgtaatatgacatatttagattcttttaccagtttaaagaagttaatttaatgggggtaaagggggctaagtttttagggttggggtcaggtactatcctttataagaaagattatgggtgtttgaagctcatgaatggacatgtcattatctttcaaattacatgctaaggatcaggtttgtatcgtatgtattttactatgccttctggtccatatctcagacaaaccactctgtgccagctgtgctaggtgccagcagccatgaactgtgccagagaccctgcctccctggcttaggttgattggactgagtggccacctgtcaccaagacagcccatctgtcacctagcaggtaacatgggcttgacgagctgagagctgggccttttgtattcctctcttaggaaattagaattgggaagctgagagcctaaggcagtttgtaacggaaaagagccaaaagatgatggggagtggagcagtcatgacagttcatgtcctagctagttttttgaagggacagaaaccatgagcaaacagagggaccttgcaagggaggaacagagatgccttgagagacagaagagctgtttcctacagacaccatgaacccagaaccactttccagttctcctgaggcccagctttatcctaccctaggattcaaatgggatacctgtattctttccacaaacctcccttttcttgagccagcttgaatgagactctgttttcccacaatggaaattatcagaccagatctaggctcctacctttacaatcgacttctgggttgagtcaacaacagttggtttacatttaaggctgacatgaagtgctgaagactattctaggtattacggggaacagtggaaaaacacagatacctgattatttctgtcaagctcagtgctgacgttatgggctttgaatccgtgttcctggcaaacagtgagaatgaaaagaggcagggatcctgactgttcatttatcacttcacagctctcaaccaacagggggccttctttatcctatttaacctctcagtagagtatttgccttttgcttattcctctttccagtcaactcttgattattcatgtaatagaggaaagcattaatgtgaatgatagaagactgccccaccttggcctctcttctctgccacagcagcatccagtcacagaaatggaaacaactagcaggagaggtaaggaggctgaaaaaaggtgggatggggccaagcaaattaacattgtttcttctacttttataccttctttctgttaataaatgctgcctgtttgagtttctcttctggtgtcactaggagattgctggaacagcaatgccatttgcttgatttaagtcaaaatatgggatcttttaaaaaactaaaatagagttgggggcaattgactaggctgttagtttcctctcccatctattgtacccccttttgtcagtgccacccagctttcttgttggctgagtttaatgttgggccactagcaaccattctttgttcaggatttgggactcagctagccaaaatatccacaatagcatttctcaaagtatggttcttgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagcagctgttttggaattagaacttaggccttctgacttccaggcaatggtattttcttccagaggtatacatttctgtaaataaagtctgaatgcattggaataacttaccctgggggttatttgtagcagtctcaaatcatttgatcagggtcactactggtgatatatagagggaaataggagagtgaagtaatgcagaacataccttctgtaatttagatttggatcatttttgctgggcctggagaggaggagctaggggagtacagcttacccatggcgctgcttacggaatttagacataagagatggctgttcattattctgggattccacatctgtacagagtgtagaacataactgaatactcagtaggtatttcttgattatgcgatttgctaaaatcactctgctagtgtgttaaaaataccatttagagttttctataccatttaccatttaattgataagcatgtggtttgataaatgttgttgttattattgttattagaagtagttttatgtagttcttatagagatataagggcctttagatcatttgatttggggccctgcctcagctattaaaaattgcattgtaccttaaatacctgttgcctaatattgtttgccttctcattgtgactcttgggggtttctgctgctcagaatagaatggaatctttcataagactggattaaagggcatacggcctaatgcagcagtctctaacctttttggcaccagggacaggtattgtgaaagataatttttccatggactgaggtggggggtgggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaataataaaggaaattcattgaacaccgttaagaaaagataatgcatgttttccttcaaaccatcaatgctttgccccgtcactgatttgcttgtgcgacccttcttttatgtcactctgaataaactcccctttgtctttctgggccgagggaaccaaatgactatagagggactcttattggagtcacacatttctttcctccttgtgactgccaaaccaccaaactctgggccatttgcatgtgtcttaatttctcctcataatgtggcaaaacacgttttggtgctaggtacgatacaacccttcctggagtgaaccaaatgtggaaagtgctgtaatttgagggagttttcagaaaagagcctcttctggtacagaaaggccctttttccttttttctttctcttttttcatttatgcctcatcatattttgtccactttcagctcatctcaggctgaattttccctttgatgtctgctttatagaatagcccttgcctgagaaaagagaacaaaaggccaactctgtggctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgttatttaaaaattcatacaattttaaaggaatagaatagcatatatgattccctccaacctctgacccctgatccactagttcttctccccagaaacaaactgccattaccagattcttggaaatcctgagaattactgcatgcataaacaaggcttgaatattctaaaatggcttttgcttaggtaaccaagtctatccatattgtatggagacatcttgtttcatttattcattcagcaagtacctgatgagcatctcatatgttccaggcactgtgttaagttctggacctacagtgaggaccatcacacagctcctgctctccagaagcttatggtcagcagggaagatcaacatttaatgaaaacatagctaaatataaatgagaaatggtgatatgtgttgtgaaggaaaagaacagcatttacatgcatctgtttttttttttttttttttttttgagacggagtcttgctctgtcgcataggctggagtgcagtggcgccatcttggctgactgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttcccttctcttccagcttatgtcctgggctgggctctggacagggagcagaggcagatgtgcgcatgtgttctggaggacttttatatgtccgatggtgtgttaggcactatgtggagtggaggcagagggaactccagaaaagataaattatcttatggtggagacaaaaggtagtattggcaacaaacatgacctctggaatcagatagttttgggttccaggcctgactctttgactcacttattagttgtgcgaccttaggcaatttatttaacctttctgtagctcagtttccttgtatgcaaacaggaggaaaataataatctcttacataataggattgctatgaagaatatatgaactaatatgtgtaagacattgactgtagtgccaggcacctagtaagcactcagtaaggaataactactgccattattgttgttactaacaacagtatgagactaataagtgattagtgtataagtaccaacaaataccaatggagttcagaaaaagaatgcttaatttttgtgacttatccaggaaatctctagaggagacagaagaagtggaatgaaatattccaggtggagcaaatatgaaagtgggaggctgaactgaactggagtggggaacaaaaagaagaaacaaacgcaacatctggcacccttgagctctaccaccagctcacctgttgtcactaccaatatgtccagtcctttatggctctccattttggagtgccctgaattactggctgcagttttgacttggccagctagttggccagctgctctgactgagcttgagggtgtctgtgccttggtggagttgacacgggtcctaactctgcaacttggtttgtaggttcaaagcctaatttttatcagcttacccagggctgttggtttctagtggattgggtcacactccccaacattacaaaacacttcttaataaatcaccaggctgataagtcgattgatgatgagagagagacctttatagagatgagaacacttgtgtgtatcagccctttctgatatcaaggtacctgaagccaaattaaacagggactgttttataacctaaaatcagaacctaatggagttgaaaagtctcatgagcgagaccatataggctttggtagtccatggaaaactgtacctttttgcatgtctgtcatagctttgtagtgtgaccagaatgtgtgtcctgttctctctccactgctggagaaacatcagtaacaatttttctcttggatgttcctgttttcaattccatgcaaatgctgtttgtgtgctatggccatgctattctcttgaatttcttttttcttgacaagatttttgagttgcctacttctcagcgacaacatagtgattctctcattgagtgttctttttggctttgttctcaaacactaggaatgtttccaagcagggccgccacgaatggctatgcactgcacaaccctaggagagggtgccattcacatagactataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtggatttgatttgcatttccctgatgactaatgatgttgaacatcttttcatgtgcatgttgagtacccgtgtgttttctttggagagatgtctgttcaaggttatttatctttttattgttgagtttttttaatactttagctatttttaatgtatatatttaaggttttcaacttaatgattatatatatatatggaaatcaccacaatcaagataacacatgcattacatcatagagttatcatttatgtgtgtatgcgtgtgtgtgtgtgttggaaatacttaggatctattcttatagcaaattttaagtatacagtacagtattttcacctatagtcgccatgctgtacattagatatccaggacttacttgtcctggaaaactaaaactttgtactttttgactaacatcttactttcccagcaccagccccagctaaccatcattttatactcagcttctatgagttagactaatttacatttcatatttatgtgacatcataagatatttttctttctggctcatttcacttaacataatgtcctttgggtccttctgtgttactgcaaatgataggatatccttctttttaaaggctggataatataccacattttctttattcatgcatccatcgatgaacatttatcttgtttctatatctttgctattgtgaataacggtgcaaggaatataggagtgcagatatccctttgagatcttgatttcaactgttggataagtattccagaagtgggattgctgtgtcatagaataggtctttttttttttttttttttgaaactatactatttttgataatggctctattgatctccatcagcagttttccagggttctgttttctccacacccttcccaatattgccatcttttgcattttttataatagccattctgacaagggtgacatgagatctcactgtggttttcatttgcatatccccaatgattagtgatgttgagcaccttttcatatacctgttgtccatttgtatgccttctttggaaaaatgtctattcagatcctttgcccattttaaaattgggttatttgtatttctgctattgagtttatgagttctttacatattttaaatattgacatcaaatttgtggtttgcaaatatttgctatatagctttttaggttgatgtagtcctaattgtttttgtttgtttgttttttacttttcttgcacgtgcttttgatgtcatattcaaaaaatcattgccaagaccaatttcaagaagtttttcctatgttttcttctaggagttttatggtttcagatgttacatttaagtcttaagcccattttgagttggtttttgtgtgtggtgtaagataagagtctgatttcattactttgcgtgtggatatccagttaccccaacatcatttgttcaagcaagcatcttttcccccattgtgtatttttgaccctctaaggttctttattccttttcatccttttttttctttttctcttctgatgaggtaattttaaataactgttcttcaaatttgctggttctttcttctgcttgataaatctcctgtttttagttgagtcattgtattcctcagctccagaatttgtttggctgttgtttacagtttctatctttttatttaacttttcattttgatcatacattgttttcctgatttcattgagttgtccatctgttaattttcttttttattgttgagtcttaagagctatttattctgaatactagactcctattagatacatgatttgcagattttttctcccattctttgggtcccctcccctcccctcccctttctttcttttttttttttttgagacagagtctcactctgatgcccaggctggagtgtgcagtggtgtgatctcagctcactgcaacctctgcctccctggttcaagcacttctcctgcctcagcaggagaagtaatcccaagtagctgggattacaggcatgtgatgtgccacaacgcctggctaattttttttttttttaatttttagtagagacagagttttgctgtgtgggccaggctggtctcaaactcctgacctcaagtgatctgcctgcctcggcctcccaaagtgctgggattacaggtgtgagccaccatgctcagtctgggatgtcttttcactttcttaatagtgtcatttgaagcatgaaatattttaattttggtgaagtacagtatatttattttttcttttgttgcttgtgcttttggttacatcttagagtctgttaccaaatcctaggtcatgacatgtatccctatgctttcttttacaagttttatagtttttgctcttacagttaggtctttgattttgagtgaatttttgtatatgggttatgaggtaggggtccaacttaattcttttgcctgtggataaccagttgtcccagcatcatttgttgaagagactgttctttctaccattggatggtcttgataccttagtcaaaaatcacttctgaggatttatttcagtactctcaattctattctgttggtctctgtgtctttccttaggttagtaccacactgtctttgttactgttgctttgccataagttgaaatcaggctgtgtaagtcctcccactttttcttttcaaggttggtttggctgtttggggtcccttgcatttccatatgaattttaaaatcagcgtgtcagtttctacaaaaaaaaatgtcagctgggattctgatacgtactgtgatgaatctgtcatttaaaactttcaaggaggagtgtaacaggatcagaatgctattttaagaataggaacctgacaatactatataaaattagagcaagcttgtccagcctgtggactgcatgtagcccaagacagctttgaatgcagcccaacacaaattcataaattttcttaaaacattatgagatttttttgcaattattttaaaaagatcatcagctatcattagtgttagtgtattttatgtgtagaccgagacaattcttcttccagtgtggctcagggaagccaaaagattggacacccgtgaattagagtgatgaaggaaaaacactggatacttggagatcagataggaaactgctgtagtagtttaagaaaatgatagggaccaaactaggaaaagatagtgagggtggatttcagatgtattgaaaaggttgggctgggtgcagtggctcacactagtaatcttagtgctttgggaggctgaggtgggaggatcacttgaagccaggagcttgagaccaatctgggtaacaaaatgagaccccatatgtacaaaaaataaaaaataaaaatagctaggtgtggtggcacatgcctgtagtcctaactactcaggaggctgaggtgagaggattgcttgagcctaggagtttgaggctgcagtgagccatgatcacaccaatgcactccagactgggtgacaaaccaagaccctgtctgaaaaaaaaaaaaaaaaaagaaaagaaaaagaaaaggtctaagtgacaagacaggatttggggactgaatacatgtggggctgagaaaggtgggggatcaggggtaactctgaggtgtgaagagaggctaatggattagattatagtaccttttaaaactttgtattattttgaaatgacttttgacttacagaagagttgtaaagatattacagagaattcctgtatatccttcacccagcttcccctaatgttaacattttacataactatggtaaaattattaaaactgaaaaattagcatttatacaatgcaatatgaacttaactacagtctttatttgggttttaccagtttttttcacaaatgtcccttttctgttgcaggatctatttaggatccttaattgcatttagatatgatctctctttagtcttctctaatctgtggtagttccttagtctttgcctttcacaaccttgactattttgaagagtactgttcagtttactctgtagaatgcccctgatttgggtttatctgatgttttttcatgattccattgagattatacaatttgggcatccaataaggacgatgctatcaatagctcatacttattttattccctacagtgtgccaggcatttgaactaggtacctcaagcatttaaattttacagttaccctatgaaataatactattgtaatcctcacttgacagataagggaactgagcctaaagggttaagtattctctgtaggcagctggacaagggaagttgagtaatatgtcagaatgttgttattgcaaacatggaattaaaacaagtgaagttagaggaattgaaaatttaatatgatttgttgctgaattggctcatagtagggatgaattttctattgaaatcaggataattatagctattatgtattgagtgctagctatgtgctaggcattgtgccaaatgcttttcttgctttgtttcattttgtcctctcccaaaccttgtgagacatagatactatttttgtctctattttacagatgaaaattcctctaatctcttgcccaaggccagagtgctggtgagtggcagagccaccatgtggatccaagtttgtcttaactctaaagcctgtattctttaaccacttggcaatgctaactgtcctccttccatcttcttagtagggatgaatttgccaatgggactagaaaacatgatatttatgggcttggatgtagacactgcttggttgtggacattaccaaatacatgtttgcaactctccttattttatacctcagtggttggtcaaccccattctttctttgggtatatttcaagcaggttacaatctggtctttcaagtctgggattttaacgcttaactcttagtaggcactcttatttcccttttattcaaattcttgagggaagcttctttataaactccttagactgacaaaaatagtaaaatctcagaaataggcaaatcaagggagataatgaaatcaccagaatgggcgtttaaccgtggagtgtaagggaagctttcctggagaaaatagtttaattttgcatttgaagggtagataagagccacaagaggaaagttggaaaaaccatctggaagagggaataggattagcaaaggcacaatttcttgatgttagagatttaaatttaaaaaataaaattatgaaaatgttaagaaaacaataggtgactctgtaatcccactgttataaaagattttcaaagcgtgatatcaaagacagaagccataaagggaatgacaaatacatctgattacataaagatttaaaaagcttccataaataaaaacctatcataaacagagctgcaacaatgacagcctgggaaaattttttgcaataaatttcagtctatattagctgtcattaatatataaatagctctttacaactcagttgaaaagaacacaccagctgaaaaacagtcaaagtgcacagatggtcacatcccaaaagaagaaatatggctggccaatatacctgttagaaaatagtttaacatttctggtaatctgaggcatgcaaattgtgtgtgtgtgtgtgttttgcctgttaaacacgtgataattaccaaatgataatgacctgtttgtcaggttgcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagaggttcggtagagaaggtgggaacctggaaccagagaggttcgcaggtagaggatgaactgggataacagctgatgcctagattggatgcttaggaaagaactaaaggttagtacagggatctttcctgaggaagctgagagagtgtgtggttttgaatggaaccgtggattttttctgggaaaaccagccaaaaaagacctcagttttataaggattgcaagtgcccaccagacctggggatgaggcaggtgggagctataatgaacctgtctttgggactctgaaactcatctatgtaaatgcaatttgctgtccagttgagtttgtgttttgagatgtctcacactgtagagagtagatcttatgagctggctgatggcacaggtgtggggctgttggggtgactccctgtgtgccatgtggtcaagggccagggctagagtctaaagaaaaggagctctcatgagccctggtatgtgtcaggtgtgaagtggaaagtgcattgaactgggagttaagggacctgggctctcatcagaaagcttgtcagaaccttttcccctcagtttcctcatctctgaaatggggtttaataacatggttctgcctgcctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccacaaaaaaataaaaataaaaataaaaaataaaaaaattagccagatatggtggtgcacacctgtagtcccagctacttgagaggctgaggtaggagaattgcttcagcccaggagttggagggtacagtgagctatgattgcaccactgcactccagcctggataacagagtgagactttctcaaaaaaaaaaaaaaaaaaaaaaaaagataccttctatgctgctatgctgatgatagaaataggcaagacagaaaagatgaaacgactaaagttagaaccatgactgatggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaacaggaaataaagagcccagcagattcttggataattgagaatggtgtaaatggctttctgatttacttaagtcattaaagtgttaggtaggggaaaaaggaccccatttgctgcttcaaatagctccctgaaatagccacttagtctcttgccttaggtgagtaactttcagctgcgtgagggataatggatcctgatttcatgtatttcttacttgaacagctcctaaaggaaaggggtatttaaccctgttttccttccttgattttccaaaatgagctcaattattcagtgtaatgttttaaaagtaacatttattggttctatttcattatgaaagtaacaattctcattatggaaaacacagggacacataaggaagaaacatcatccatcccaaatccaagcaccaagagataattttgcttattacctttcttttcttaagaagcagagatcatattgtatattgaggtgtttactgtatcttttctaaatttaacttggtttattgatacattcatataggtgtgtaaatcataaatatgattgctggatttttttttgtagtggtcctttcttttccctttttttcttcagctcctagttctacctttccacactatccctttgtattaccaaaacagtatgtatcttttcacattttactccatgtgcatagatatacacatgcatacacacatacacacacaagttttggaatgttttgttgttgttcattgtttgttttacagaaatagaatattatatatactttaatatatctttttcattctacaatatctcatagaaatctatcacagtctattgatgtagctcttattcttttataatgttgtaaaatattccatgaatgcacaataagttattcagccattcccctattaatgaacatttactttctttgcacatttctgccactacattcaatgcttaaatcaacatgattttgtatatacccttatatactgttgctttcagtttagatatagatgtaggtagaggtatataggtatatgggaatgtttaaatatatatttatgttaatagatatcgccatattgatttataaaaacaggctgttatgctacactttttgcttttgtatgtaatatgtgagattattattttcttcttatccctatcagcaacaggtgttaatggttcttttgtaattttgacaacctaatggatgcagtttcttggctactagtgagtttcagtattatctcaattttttgtccaattaaatttgttcctcgagttgtctattcatattatctgcacattttcctatgggttgtttatatttttctaatttctaagacctctttgtatattttagattttagccctttgtctatcatcattgttacagatacctttcccaaatatgtttatattgacttttttttttttttttaattatttttttagtagagatggggtttcaccatgttggccaggctggtctcgaactactgacctcaagtcatctgcccgcctcggcctcccaaagtgctgggattacagatgtgagccactgcgcccagcctatactgactttgttgatggaatatatttccatataattgtttgcatttttatatccaaatatgactcttttcttatatagcatctgaatttcaagtcttggttaagatagttttcttgaagataggtagccagttgtattggaataatatattaaatgatccctattttaccctgtgatctctttgcagctattaaatgttttatatgctaggatctacttatggattctctattctgtttcttctttttgtctatttgtgtacccaaatctcatatatttgattacattaggctttaaaaaatatttttctggggccgggcacggtggctcacgcctgtaatcccagcactttgggaggctgaggcgggtggatcacttgaggtcaggagttcgagactagcctggctaacatagtgaaaccgcatctctactaaaaatacaaaaattagccaggcatggtggcacatgcctgtaatcccagctactcaggaagctgaggcaggagaatcacttgaacccaggaggcggatgttgcagtgagccaggactgtgccactgcactgcagcctggggaacagagtgagactctgtctcaaaaaaaacataaaaaaaattcttggctatttgttgtcacttgttcgtacacacaaattttaagatcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttctggttttgaactactcttacattattgaaatacacccgctgatcatagtatattattattttgatacattgctgggttctatttgtcaatattttatttagaatcttgcttcaatattcccgagattagagtcatgtttttcttagtgtttttttcttcaagtttaaggattgaggccaggtgtggtggctcatgcgtataatcccaacactttgggaggctgaggtagaaggattgcttgaggccaggaattcgggaccagcctggacaacataccaggactttgtctctacaaaaaaaaaaaaaaaaaaaaaaattaaaattaaaattagcagggcatggtgttgtgtgcctgtagtcccagctacttgagaggttgaggcaggaggatcacttgagcccaggagttcgaggctgcagtgaactatgattgtgctgctgaactccagcttgggctacagagcaagactccatcttttaaaaaaaacaagtttaaggattaaagttatggtggctatgtaaaatatactgcagaatgttccttctttttctcttgtctggaatactttaactaccgttagaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatccttagggatggttttgcacttactatcctgctactaacttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagtttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacacttgaaaagacatttcccattctaaggttagaatgggatttaaaacaatccagttttaaaatagttttaaaaatatttaacttgtcagtccatcaaaaattcattttgtgactagtatgaagtagagtatagcttatattttcccctagagagtcatttatttgagcaccattcatcaaataactattttcctatgattattgctattatacttttatcatacataaattcttctatatgctaggattttttcagcttgtattattcattgatctctctcttgggttttccatcagtttcatacccttatatatgcaacagctggtaaaccagatttcttttgctttctctgcagcctagcgcattacccacacttttttcttagctagtctcaaccattttttcgtccaaatgaacttagaatgtttctgtcaggttctcctcaaaatcctaccaggattttgattggaactactttaaacctaaaatttcattgacatcatcacaacacagagtctgtcatccaggaaaagacatgatatgttaatttattaattttcttttatgttccttagttgctcacatgcatgtgtgtgtatctcatatatttctcatcaagatcatccctggatagttgatagtttatgatatttattatattttcaaactagttattactggtaggtaggaaaatttttgattttgtgtgtctatgcttaattcttatttctaatagtttttcagttgcttctcttggattatttttgaaattaatcacaccagctcccatatgataactttatttccttttaaagaacaaaactgctgttttgctttcaaacctgattgtattggctagatcttttgggataatgttaaataatagcagtactagcaggagtccttgtcttgcttctgattttaatggaaatgtttctagtgattcacttaatagaaatgtttctaatggttcatattagttggctctgatgttgtctgttggtttaagttagatgttttttataatattagggaattaccttattcttaaattatcaagtcctcacaaaaatcaagaatagttggccaggtgtggtggctcacgcctgtaatcccagcacttcaggaggctgaggcagaaggatcacttgacatcaggagtttgagaccagcttggccaacatggtgaaatcccatctctactaaaaatactatatatatatagtatagtatatatatagtgtatatatatatagtatagtatatatatatagtgtatatatatatagtatagtatatatatatagtatatatatatatagtatagtatatatatatatagagagagagagagagagagagacatggtggtgcatgcctgtaatcccagctactcgagaggctgtgggaggagaatcgcttgaacccaggaggtggaggttgcagtgagccgagattgtgccactgcactcagcctggttgacaaagtcagatctgtctccaaaaataaagaatagttgttgagtttagctgatgttttctaggaatctattaagaggttcatttgtgttttctactttgatctccccatttggtatattatattatagatttcctaatatcaatctttgttagctttctaagataaattttccttttcctttgcatgcttgggagagcctcagatttggcttccatactattaatttgattgattttgctctctgctgtctccaatgtgaaatttatttatttttgttacaatgttaatttctctgtatttctttctagctctgttgagctacttaccctaggttgtctttccttctcaatgttttattctagtggctttctatacctgtttcatagagtccatgttttctttcattctattgaggatgtaaacagttttctaaaatatttcttctggtttatacacaaaattaagacgtttttgtttcctctgagttgtcagagtgatatgcattttccttgtgctgccagaggttttcatatgaactttttttttttttttggtaaagcaacagggtcttgctctgttgcccaggctggagtgcagtggcatgttcatagctcatggaatcctcaaactcctgggctcaagtgttcctctcacctctgactccaaaatagctgggactacaggaaaacaccaccatgcttggctaattaaaaaaaatatatatatatatatattaaaacagggttttgcggtgttgcccagtcttgaactcctggcctcaagtgatactcccaccttggcttcccagtgttaggaataaaggcatgagccaccatgcctggtcaggttttttgtatggtttatgaatattcaaaaaaggatctgtctttcatcaaatacagggtatgtagattgcctttgactatcctcaagctcagattctctctcatattggttagaacccttttcagctccattgttggcaggcaggttgatacacatagcttttaacctgtttcacagtgtctgtcagctactcatctagtgggttctgctggacccatatggaatcgtctacccctactacaatgttctcagatgctctgaaccagataaactatgtgaaacagtacagcctcccacatgtgttactacctgagtgttacttgtgagggctcccactcctagcacacagtgtgccagtaccaattctgccatttctgcccttttgattttggggaattagagtctccatgtgaatgtagaccagttttgagaattgctgatttcctctgcaagtagtaaccacgtagtccaaatggatgtccggtttgccagtttctagatgaactcttggcttctaagccatgaggctgacagttgtggaaggactcaatgtttcctatcttcttttaggtttctgtgggctgctgcatgaattggccagattgttttttctcatttcagtattaggcttattgttaatggagatttctcccagatcctggtaataagttggccatcagtttaagttttcagtgtttggggaattttatctttttctatatcttgataggtatttgagtgggaaattgagagaggctatgttagtgattgctagccaagtgctattttaaagtagaaatccagtgtatattttagattagagcagagattggcaaccatttcctgtaaagggccagagagtaaatattttagactttgcaagccatatgatctctgtgttttaactatttaactgttgttggagcatgaaagcatcacagaaaaatgcaaacaaattagtgtggttgtgttcaaataaaactttatttacataaacaggaggaccagatgaaaaagttctggagatagctggcagtcatggttacacaacagtgtgaatgtacttaatggcactgaactgtacacttaaaagcagttaagttggaaaaaattttatatatatatgtatatatgtgtatatatgtatatatgtgtatatatgtatatatgtgtatatatatgtatatatatatgtgtgtgtgtatatatgtgtgtgtgtgtgtatatatataaaatcatgccaataaagaagccaaaacagaaaaaccatattttgctgactctgagtttagaggaattagatctagcataggcagagagagagaggaagaaattacatatgtacagtaggacagtgactctgttaataagctagaaggcagtgggagacatttgagtatttaagaggaataccataatggggatggtgagatcttggaaagctacaattcatcctagtgatgtcatcttatgatctttacagatggagatacacaagagttcacattcacattctttgacataaggatcagagtagggcttttctacttctctagaggcttgagaaacctctgcagctgtcagaagtgttcatatcagaaacaaaagctaaccagtcatttctttttgcttgtagtacaaatggtgactagtgatgcttctggtagttgatctgagctcttcccaggactagaagatcctagcattttagttattaaccacagcacacttactcaataaaagagcagtcatcagtctgagtcaactgtttatacagcctccagcctaagattcttccttatcagctagagacctgggcttaagaatttcacaatgggctgggagcctcttagagaaactagccttttgagactttctctgagttgggctctcttgtttgttgttgttgtttttgaaactgtctcactctgttgcccaggctggagtgcagtggcgtgatcatggctcactgtagcctcgacctctgagttgggatatcttgaaggaatacatgaaggaaaagggaacagagattaaggttttccaggctttgggttgtaatcagacagtttagctgtattctgaacacccagcacttaatgtgcttggttatccatgtgtatgtatcaagggtgggggaactcatggagtgagtcactgagtggtatggtttaaatggcaggaaactcttccctcaccccgccttgggtaagaaaagggcatagcagagcgctgacacacatccctctgctccagaaagtgtacagtacccctctgctccccactgaaaccctaaagttgttcatcttcatgtgtgccaggaaaggagtggatctgtgatgcaaataggattatttggtcatatctgctgactcagtctaaagaagcttttgaaggggatgagatgaaatttcatctatgctgcagagagcaggaggtgcattgctggatggagagaggactgtaggctgcatgtgagccaaggtagacgagggaagcatgggggtgggcatgaggaactggggcagcctgacacgtgatcttggcattgcaaaactgatatcctgttggcctttgggccacatgatatgatgacagtgcagtatccccatggccctttctttttctagatttcatttatgatactctcagatttttaaatagcatgactttccccagggagaaattcagacctcaggtctctaggactgctctgaggtcatgagatagactcagtttgaacctgttgagtttaaatgtcttggaatgattttagcatctcagtaccccctttcccagtgctcatctggtcagctgctctggaacctgagggattctaaactgagacttagtttggggtcatatgcagttaaaaagggacagtcttttggcaccttcacctcggaggtggctgctttttggcttagcgttggactcatcactgaaaaagatagttgagaggttgtttttgacctgagcagccttattaagactcagttattggcaaaggagagaaggctctgcttataaatgttgcagatttaaaggggaaagaggaaaccacagtaagtaaagagcgattcagggagaccagtttctcttttttattcagaatgctgctcaggtatctgctttcctaggagccaccttattgtcaggttctgccttcggtttatgtgtattcttcccttaattcttagaagagggaagatgctttggggttgttcacaggttcccattcgacataaaatagaagctgcctacctttacatatactcagttttatcttctccaagtctcccagaagttctctttgaaagttcctagagcagggactgcttttattttttttccttctcctaggctttaagcatgtatttagatgtatgtcaccattgggtaaaagaaaggctaaagattcagataacttttcccatctgtggaaacatggaaagcagtactcagcagaggaatgaggactgattattttgggcctctttttactttatccaagtgaagaatctactgtgctatatatttgtcaaaagcaattccaaagggcaggggttgggggaaagcagtacggcataataagatttgggcaagttagataggagctgtgcagttggtaatgaagaagcagaactgtttctttctcattataaaagtaatccatgctaattgtaaggaaaagaaataaaatattatagaaagcaataaagaatacaataataataactgataattcctgttaatatgttggtataatttcttcttagttttctgtaggtatagatttcggctcactgcaacctctgccacccaggttcaagcgattctcctgcctcagcttcccgagtagctgagattacaggcactgccaccacacccggctaatttttgtatttttagtagagacagggtttcaccatattggtcaggctggtcttgaactcctgacctcatgatccacccacctcagcctcccaaagtgctgggattacaggcgtgagccaccatttttagaaacaaaataaagatcattctacatatgatactttgtaatatttaaaatataacgggattgtttacccatctaattaagtattcttaacatgatttctgatggctacatagtattccattgtttggatgaacataatataatgtatttaaacactgttctgttcaattcagcatttgatttatcgggtagacatgttttgaagggatcttgaatagtacagtggaattagagttatagttgcggttctgcttaattcttagctctgtgatcctgagcatagattaaagtcttagcttccatttcctcatttgtaaaagaatgctattaatagtaatgaccctcctgagtaaaaatggttagatgacatgacccatgtaaatttcttagcatgaaatctaacatataccaggaactcaataattgttagtagtagcgtatagcattatccttgtcttgacactttgtcatctgtgtactcactgttagaatttgggtctcaaggaaagaaaattgctttcatttagataagtaaaatttcagaatgaaaattgcctttagataggtagcctcttttaccagttgagtaccttccagataggggcatttgccaacttcctgaatttcacagggaaaaaaaaaattctgcagtctctgtggttgtgcggccccatttggttcagaacaaggaagtgggaaaccaccagctgcaaccagggaattatctttgtgtccgcaggcaaagccagccaagcccccctgttctacttatctttttttttttctttacttgcttgttttttatgttcttttagtctgaatttttttttttttgagcagagtcttgctctgttgcccaggctagagtgtagtggcacaatctcggctcactgcaacctctacctcctgggttccagcgattctcctacctcggcctcctgagtagctgggacttcaggcacatgccaccacactcggctaattttttgtatttatttatttttttagtagaggtggggtttcaccatattaaccaggatggtcttgatctcctgactttgtgatccgcctgtctcagcctctcaaaatgctgggattacaggcgtgagccactgcacctggcctggaaatttttaaacatacggaaaagtgaatagcgcagtacatagaatacttgtatagcttctgcttagtctcagcagttgtcctactttctttatttttattttttattatactttaagttctagggtacatgtgcacaacatgcaggtttgttacatatgtatacatgtgccatgttggtgtgctgcacccattaacttgtcatttacattaggtatatctcctaatgctatccctcccccagccccccaccccatgacaggcccggcgtgtgatgttccccttcctgtgtccaagtgttctcattgttcaattcccacctatgaatgagaacatgcagtatttggttttctgtccttgcgatagtttgtggagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatacacccagtaatgggatgactggctcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcactgtggttttgatttgcatttctctgatggccagggatgatgagcattttttcatgtgtcttttggctacataaatgtcttcttttgggaagtgtctgttcatatcctttgcccactttttgatggggctgtttgattttttcttgtaaatttgtttaagttctttgtagattctgcatattagccctttgtcagatgggtagattgtaaaaattttctcccattgtgtaggttgcctgttcattctgatgttggtttcttttgctgtgcagaaactctttagtttaattagatcccatttgtcaattttgtcttttgttgccattgcttttggtgtttcagtcatgaagtctttgcccatgcctatgtcctgaatgctattgcctaggttttcttctagggtttttatggtttcaggtctaacatttaagtctttaatccatcttgaattaatttttgcataaggtgtaaggaagggatccaatttcagctttctacatatggttagccagttttcccagcaccatttattaaataggtaatcctttccccatttcttgtttttgtcaggtttgtcagagatcagatggttgtagatgtgtggtgctatttctgagggctctgttctgttccattggtccatatctctgttttggtaccagtaccatgctgttttggttactgcagccttgtagtatagtttgaagtcagatagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatatcgatacttcctatccatgagcatggaatgttcttccatttgtttgtatcctcttttatttcattgagcagtggtttgtagttctccttgaagaggtccttcacatcccttgtaaggtggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctgatagtttgtatttctgtggaatctgtggtgatatcccctttatcattttttattgtgtatatttgattcttctctcttttcttctttattaggcttgatagtggtctatcaattttgttgatcttttcagaaaaccagctcctggattcattgatttttttgaagggtgttttgtgtctgtatctccttcagttctcctctgatcttagttatttcttgccttccgctagcttttgaatgtgtttgctcttgcttctctagttcttttaactgtgattttaggtgtcaattttagatctttcctgctttctcttgtgggcatttagtgctataaattttcctctatactcagctttaaatgtgtcccagagattctggtatgttatgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgttcagaagaatgtatattctgttgatttggggtggagagttctgtagatgtctattaagtccacttggtgcagagctgagtttaattcctggatatccttaactttctgtctcattgatctgtctaatgttgacagtggggagttaaagtctcctattattattgtgtgggagtctaagtctctttgtaggtctctaaggacttgctttatgaatctgggtgctcctgtagtgggtgcatatatatttagaatggttagctcttcttgttgaattgatcccttttccattacttaatggccttctttgtctcttgatctttgttggtttaaagtctgttttatcagagagtaggattgcaacccctgcttttgttttctatttgcttggtagatcttcctccatccctttattttgatcctgtgtctgtctctgcacatgagatgggtctcctgaatacagcacactgatgggtcttgactctttatccaatttgccagtctgtgtcttttaattggagcatttggcccatttacatttaaggtcaatatggttatgtgtgaatttgatcctgtcattatgatgttagctggttattttgcttattagttgatgcagtttcttcctagcatcaaaggtctttacaatttggtatgtttttgcagtggctggtaccggttgtttctttccatgtttagtgtttctttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccattctcttctggcttgtagagtttctgccgcaagatctgctgttagtctgattggcttccctttgtgggtaacccgacctttctctctggctgcccttaacattttttccttcatttcaactttggtgaatctgacaattatgtgtcttggatttgctcttcttgaggagtatctttgcggtgttctctgtatttcctgaatttgaatgttggcctgccttgctaggttggggaagttctcctggataatatgctgcagagtgttttccaacttggctccattctccccatcactttcaggtacaccaatcagacgtagatttggtcttttcacatagtcccatatttcttggaggctttgttcgtttctttttattcttttttctctaaacttctcttctcattgcatttcattcatttggtctttaatcactgataccctttcttccacttgattgaatcagctactgaagcttgtgcatgtgtcacctagttctcatgtcatggttttcagctccatcaggttatttaaggtcttctctacactgtttattctagttagccattcgtctaatcttttttcaaggtttttagcttctttgcgatgggttcgaacatcctctttagcttggagaagtttgttattaccgatcgtctgaagccttctgctctaaacttatcaaagtcattctccatccagctttgttccattgctagcgaggagctatgttcctttggaggagaagaggcgctctgatgtttggaattttcagcttttctgctctggtttctccccatctttgtggttttatctacctttggtctttgatgatgatgacgtacagatggggttttggtgttgatgtcctttctgtttgtcagttttccttctaacagtcaggaccctcagctgcaggtctgttggagtttgctggacgtccactccagaacccgtttgcctgggtatcaccagcggaggctgcagaacagcaaatattgcagaacagcagatgttcctgcctgatccttcctctggaagcttcctctcagaggggcacccggccgaatgaggtgtcagttggcccctactgagaggtgccacccagttaggctactcgggggtcagggacccacttgaggaggcagtctgtccgttctcagatctcaaactccatgctgggagaaccactactctctttaaagctgtcagacagggacgtttaagtctgcagaagtttctgctgccttttgttcagctatgccctgtccccagaggtggagtctacagaggcaggcaggcctccttcagctgcagtgggctccacccagttcgagcttcctgcctgctttatttacctactcaagccttagcaatggcagatgccccttccccagccttgctgccgccttgcagttctatctcagactgctttgctagcagtgagcaaggctctgtgggcatgggaccctccgaggccaggtgcgagatataatctcctggtgcgccgtttgctaagaccattggaaaagcgcagtattagggtgggagtgtcccaattttccatgtactgtctgtcacggcttcccttggctaggaaagggaattccccgaccccttgttcttcccgggtgaggtgatgccctgccctgcttcggctcatgcttcatgggctgcacccactgtccaacaatccccagtgagatgaacctggtacctcagttggaaatgcagaaatcagtggtcttctgcgttactcatgctgggagctgtagatgggagctgttcctattcagccatcttggacgggcaagtgtcctactttcttatatgtgaattctgaaacgcaaggtcctaactgcactccctgccacaagacagacaggattgcgctacagcacctcacaaagtgggaaaaaaatgtatacactcttagatccaggggtttatagaaacagaaagtcagtgcagaaggactctggactccgggatggtagaaatagattttattttttcagatggagtctcactttgtgcccaggctggagagcagtggcatgatcttggctcacttcagcctccgcctcctgagtagctgggattacagacgcatgccaccatgaccagctaatttttgtatttttagtagagatgggatttcatcatgttggccaggctggtctcgaactcctgacctcaaatgatctgcctgccttggcctcccaaagtgctgagattacaggcatgagccactatgcccagccagatcttttgtttttataatacaaatcacagaaagtaaatcttagtgtctggctgaaggaaagaagtagatccagatgtccatcaacatgacaatgggtaactaccttgtggtatattcataaaagtgaataatattcagcagtgaaaaacagatgaagtagagctacatgtataaacatggataattagaagttaagtgaaaaatgtaatttgcctaataatctttctctatacaatgtaccatttatttaagggtataaacatgaaacaacactatatgtgatttgtagatacatacaaacataataaatgtataaaaacgtgggcaacaaggaagtcaactactttagagtagaggttccccttgtagatggttgggtgagatgaatcgtattcaggaagggtacatagaggacaactgaatcaataatattcaaatttattaaagctgtatggtaggtgcagaggtgctaatttttaaaatattttactgtatgtttaaaactttaagtgtaaagaaaaaactagggcagaaaaacgttgtttaaaatgctcagaatcctggatcacttattttgtgagtgtgaaagctgagactgggagagttcagtgttttgcttctcatatacatttttgaattttgttcaattatcatacagccaaattggcttttttgggaataaagttctatgaatcttaagacatgtatagattattataattactaccacagacagggtttagaactgctccatcacttctaaaaacttctcatactcttcctttagtgtgacacccagatttctaaaccctggcaaccactgaccagctctgcaatcactgtagttttgtcctttggagaatgtcatacaaatggaaccttacagtgtgtaacctttagagagtgggtttgtttacttagcataatgcctttgagattcatctgagttgatacatgtatcaattgtttattcctttttatttctgagtggttttccatggtctgtaggtaccacagtttgtttatccattcagccattgaagggtacctggactgcttccagattttgtctattatgaatagagttgctgtaaacattggtgtagagggttccatgtaaacataagttttcatcttagtagggagccaggagcagaattattgagttgtagggtgagtactagtgtttttaacttatgaaagttttttctttttctttttttattaaaaaaaacctttataagataccatcaaatagttttccaaatcagtgcttttacatttacattcctaccaacagtgtatgaaaattccggtttctgcacattgctattgtcttttttgttgttgttgttattatagcaattcagatgagaagtggcatcttattatcgttttagtttgcatttctctaatggtagggaacatttttatctgcttatttgccgtgaaaacaacaacatattcaataacaacttcttttggtgaagtgtctgttcacagttttttcagccctttttttttcttctttttttttttttgagagggagtctcactctgccacccaggcgtgatcttggctcactgcaggctccgcctcctgggttcacgccattctgctgtctcagcctttcacgtagctgggactacaaggcacccgccaccacacccggctaatttttttttttttttttttttgtatttttagtagagacggggtttcatcatgttagccaggatggtctcgatctcctgaccttgtgatctgcccaccttggcctcccaaagtgctgggattacaggcgtgagccaccgctcctggctgagttgtgtgttttcttattgttgaatttcaggattctttatatattctggataaaagttctttgttggatatgtgatttgcaaatattttatcccatgttatatgttatatagcttatcttttcattgtcttaaagtgtctttcacagatcaaaagtttttcattttgattaatgtcagtttatcattttttttttcttttatgtattgtgtttttggtgtcatgtctaagaactgtttgcttaactgaagatcacagattttttcatatatttccttctaagacttatagttttatattttctatttagatttatgacttagcttttatataagttgtgaggtttaggttaagtttgttattttacatatgaatgtccaattgcttcaaccgcatttacactattttcaaaaatcaaatgattatatttgtgtgggtcaaattctggactattatgtttcattgattgatgtgtctattcttgggcaatactgcattgtttcggttgctttaactttgtagtaagccttaaaatcaggcaatgtgactccttcattatctgcttcttttacagaattattttagctattcctgtttctttgaccttccatatacactttagagtcagtctatctataaaatatcctgttgggattttgatcagaattgctttgactctatagatcgttttggtgagaaatgacatctttcctatgttgagcctttcagtccttggacaaggtatgtctttccatttatttaggtcttttattttatcagcattttgccattctcagcatatggatcctttaaatattttgttagatttatacttaagcatttcagttttttgaaacattttaagtggttctttcaaaaatgttgcttttcaattgtacactgctactgtgtagaagtgattgatttttgtgtgttgacttcgcatcctgtgacctttaaaaactaatgtattttttaggagcttttttgtagattccttgggattttccatacatataatcacgtccattgcaaataaggacagttttacttcttccttttcgatctctattatttttgttgcctgatttcctcgctaaagttgccagtctaatagtagtggtgagagtggacatccttgtcctgtttctaatgttgtcggggggagcatttagtctttcaccattaagtattagattaggcatagtaattttaggtgccctttatcaggctgaggaagttccctacatcaggttgaggaagttccctactattcctagtttgatgataatttttatcatgaatagatactgaattttgacaaaataccctttctgtatcagttgatatgatcacgtactttttagtcttttttagtcttttcagcactgatttggtgaattatattaattgaatttcaaatattgaactaaccttgtgttaccaggagaaaacgcacttggtcatagagtattattctttcttgtttttgagatggagtctcgctctgttgcccaggctggagtgcagtggcacaatctcggctcactgcaagctctgcctcctgggttcacaccattcccctgcctcagcctccggagtagctgggactacaggcgcccaccacctcgcctggctaatttttgtattttttttttatttttatttttttagtagagacggggtttcaccttgttagccaggatggtctcgatctcctgacctcgtgatccgcccacctcagcctcccaaagtgttgggattacaggtgtgagccaccgtgcctggccaagtattattctttctatactgctactttagatttgctaatattttactgaggatttttgtgtctgttgttcatgaggaatattggtctgtctgtccttccttccttccttccttttcttcctgcttccttcttcttccctcatcttcttctttttcctctattttcttcttctcttcctctccttcctccccactacccaactcctctagttttggtatctgggtaatgtagtgatggaccattctgtttaattgattgatgtgttcattctttcccctcttcaactcaacatgagaaatgtttccttctcttttattttctgaacaagattgtataaatatttggtagaattggtcactgaaactgagtctggagatttcttattcagatgattttaactatgaattcaatttatttaatagtattattcaggttgtctttttcatcttgggtgagttttggagtttgtggtttttgaagaatatgtccatttcatctaagtggtcaaatttatgtgcatagagttggttggagtattcttttataattttaattgctagggttctaatatcttctttcattgctgatattgttaacttttttccttctctctttttatccatgtcattctacctagaagtttataaattgtattgacttttttcaaagacaaacttttggttttattgatttttttttttttttttgagacagtgtctcactctgtcgcccaagctgaagtgcagtggcatgctcatggctcactgcagcctcgacctcctgggctcaagtgattctcccacctcagccttccaagtagctgggactacatgtttgcaccactacatccagctaattttttaaattttttttgtagagacaaggtttcaccatgttgcccgggctggtcttgaactcctgggctcaggtgatctccccgccttggcctcccaaagtgctgggattacaggcgcgaggcactgagccctgcctctctattgtttttcttttccatttcattgatctctgctctttattatttcattttttctgcttgccttgggtttattttgctcttattttttttattcttaaggtggaagcttagattgctaatttgagaccattctttttgcctaatataagaatttccagctgggtgcagtggctcatgcctgtaatcctagcactttgggaggccgaggtgggtggattgcttgaggccaggagatcaagaccagcctggccaacatggtgaaaccccgtctctacaaaaaatacaaaaaaaaaaaaaaccaacacaccaaaaactgggcatagtggcaggcacctataatctcctacttgggaggctgaggcaggagaatcacttgaacctgggaggcggacgttgtagtgagcccacatccggccactgcactcccgtcctccagcctgggtgacagagtgagactgtgttaaaaaaatttttttcctgttactagcatatttttgttgttgttgttcagttcaaaatattttataatttcctttgagaattcctatctatgaatttgcctttccagccatccagagaatttgtcatctgttccatatctttttgttcttggttgttatcaagtactaaattaaaatagaattcatctcgtgaaggatcataatagcttcatttgttatgaataatgtgatattcatttacattgatctgttaaggataatacagccactgtatattgagtgcttattatattctaggcactacattgatcactttacatggtcttattttattaaattctctaaccctttcagtaggtactcttattagttcaattaacaattgtgaggcaattgacacatattttaagtgatttgtctgtagtcacttggccagtaaatggtagggatgggatggaatgtagacttgattccaaacccccttaaccattttactacatttcctctagttatttcacttcttgccttctcataaaaattgttagctttttgagggcagatactgtgtcctacttatacttatcttcttttccctacaatacctgcaacaatgttaggcacacagtaatggattgactaatgtttgtggaactaaattcaacaaaattaactgatctagaagagaatcaaaaccatggtgcttgccatattgcctcagattcttaccagctaagcagactcagtgtagcatcctatacaaaaccaaaaaagcttataggaaatatttgtgtcagtaataatggctatcttgtgttcttttgtgatgatcagtcagatgtggccacaagagtagacagaggagagggtaaggaaaaaacaaagtttattatattcactggtcccagagacaagaggctcaggatactaggcaaggccacttgggaaagacattagggtggtcaggaggcaggagataggagcaaggaggaagttttagtccactgcctttattggggtttccacagaaaaagcagggcagggcaggacagggtgaatagttaaggattggctagtttgaatagtttcagcaggcctctaagctgtagggctgcaccctagttgtctggtgtctggccctggggcaattaaggaagaggaatatagcctcctggggtataaggggcagatagaggaggtctggctttggattggttagtttgcatatcaaaggcatgtttctgggtgagtacttgctgtctctaagaattggctggaggatgggggtcggggtgggggcaggctgtctctagccagaaaggtttttaaagataccaaaatatcacaatatacagaaaataaaatatatgctgcatatcaagcaattcaactttttcttgtaatatcatgacttttctttgcttcttgggagcacttccagcatgactggtggcacttcatctggatcccctggtgttattcaggggttacagtatcacactaaacaggatggaaaacatgagggaagggtcgacccttgaacaacatgggtttgagctatgcaggtccacttagaagcagattttttcaataaatatattggaaaaaggtttgggggtttttgacaatttgaaaaaatttgcaggcaagtcttatagcctagaagtattgaaaaagattaagaaaaggttaagtatgtcatgaatgaataaatacatgtagacactagtgtattttatagtttactactctaaaatatacacaatctattacaaaaagttaaaatttatcaaagcttatgtacacaaacacttatagactgtacattgtgccatcgtaattgagagatgtaaagatataaagatgcactattaaaacataactgcataaaattagctgtagtacatactgtactcctgtaataattttatagctgcctcttgcagtgagctcaggtgttgtgagtatcccttagaatgccctgtgcccctgatcatctccgaatgggctgttctttctccagtaaatggttgatcccaataaaaaagtgatccttgtggttctcgcatttttcatggtgtttagtgcaataccataaatgttgaataacaccagaggacccatacaaagtgcactagtcatgctgaagtgctcccaagaatcagagaaaagttaagacattacaaggaaaagttgaattgcttgatatgcaccatagattgaggactgcagctgcagttacccactattttagacgacgattcatcttgtgaacagatgatgcaaacttatggtattgataaatgtagtacagtactctaaatgtattttctcttcctcatgactttcttaatattttctcttctctgtaagaatacaatatataatacatataacatacaaaatttgtgttaattgatctcagtaaggcttctggtcaacagtaagctattggtagttaactttagaggagttaaaagttataggcagattttagactgctcagggagtcagtgcccctaacctccacattgttcaaagatcagctgtatatacaatacaaagaccaatactctgagctggtaaggaggtttataagtatgactaaccaaatataagtctgccccaagctctgctttttggttctggccttcagtctgtccatctgctttctctggacctccttctcatactttgaattttttaagtagtttgtccctcatatgattttttttctattcctttttcccttcctgtccttccttcactcctttccctcccacctccctccctcccttcctctctcccttccttccttccttccatccaaccatccatccatccatccatccatccatccatccatccatccatctatccatcttgaggctttaggtgagttcttcaccatttatttaacaaatgttttatatgagtcttactatatgccatgcacattttaatgcattttttaaatataattcccataacaatcctatgaattgggtactattatggttcctattgtacagatgagggaactccctcacaggactttctagtggccctatagccatttgccacacccattacaaatttttgtggcaggctggaggggggtataaagttaaaacaaaggcctctgcttctgagttggtcagtcatttacctgtagagctgtgctttgtcggtaaagggcaatgtagttgtgtgatcaggatagttgccacagaacacacaaggggtttaggcatgaccttccttgccccattggcacgcaagaactttttccttcctggcctgcagtctgatacatacacacatagaaacacagacacacacacacacacacacacacacacacacacacacacagacacacacacagagagagagagagagaatgagagagagagagagagagagagagagagagagagagagagagaacatatgtaacattcatgccatggatttaaagcagagtacaatggcaaaaatacaatcttgaaacttggcgacatctgagcgtgacttcagcctctgccacttattgtctgtttgatcttgggcagatcacttaatcacttggagctttggttttctccactatgaaatgaggaagatgatggtggttataataaaaactctgatgactgaatgagatgatatatttgaatccttagcccagtgatttgcacatagaaatgttcaatacatgttagaaatgtttgtgattattaatatgcaaggcttctttatgtattaaagataattcaccctctagcatatatatagcttgtataaactgaattttgagaacccagagcaatgcttgtctttatctagggacttaactgttttggatcttgatgttagttttatcttcatctttggccgtccgtaggtcctgatcagttccatcaacctcaagatttaacttttggtgtccaaatgtctaattggccctgtgcaaatgctgacatttcttttgaggtccatggcaaagcctggcaccagaatccagcttttttttttttttttttgagatgcagtcttgctttgtcactcaggccggagtgcaatggcatgatcttggctcactgcaacctctgcctcccaggttcaagtgattctcctgcctcagcctcctgagtagctgggactacagacgcctgccaccatgcccagctaatttttgtatttttagtagagacggggtttcgccatgttggccaggctggtcttggactcctgacctcaagtgatcctcccgcctcagcctcccaaagtgctgggattacaggtgtgagtcaccacgcccagcccagaatccagctttcatctggactgttgatgtgatttttttttccctctcccagagtgagtctttatgttgtggctgtcacataggagggcccaggggcagggttaagccagattctacttcactgaaggcctggaatggctgttaatagctcctgctatagacagtgaggcttgagccagattttttagtactccatttgtcagacacggggtgccaccttgaatgacactgctgaaaaaggattgtggtaacctggccagccccagggaggttggagtgacattgcgttggtgtgcctcttcccttttatggaccaggccaagccctattaacctgaaggagtgtgatggccttgtttagccaaacagccttttccactttagtcatcctttgaaatcttattaagccaggggcagggaaggaagaaggaggcagacagactcttgaaactaaaaggagggaaagaggaacattctaaccttccacctgaggtcatactttggcaggaggaagggaccagggaattttatacaaggcagcaagagagatataagagtttggggtctggagtcagataaacctggttttgaattctgactctactctcttatgtgtggtgttgaccagatcacctcacttctctgaaactcgtttccttatcaacaaaatgggaaaagtaattgtacctatctcagaagattggtataaaaattaagcaagaaagttcatgtaaagcagttaatcagatacttgcctggaatattattatttttcttctggttcttgattaaggatgcctggaatatattaagtgcataccatcgctattcgcaaagttttggtgacaaagaacaataggaagaaacagcctaggggaagtgaaaagcagtcttggggtttctgtgccattctccggggtctccttgtaacatctttcagtctgtctcccttcccttcttccctttttcccttcttccctcccctcccctcccctcccttcccctccccaagtcttgctctgtcgcccaggctgtagtacagtagcatgatctcggttcactgcaacctccgcctcctgagttcaagcgattcttgtgcctcagcctcccgagtagccgaggttacaggcgcctgccaccatgcctggctaatttttgtatttttagtagagacggggttttgccatattgtctagggtggtcttgaactcccgacctcaggtgatctgccagcctctgcctcccaaagtgctgggattataggcatgagccaccgcacccagccacatctcttagcgttacaaacacatctgtgagtgccaagagaagaggtaaagttctagagagtcttcaacatgtggactgttttcccagccagggcataggaggtatgctgtgtgtgtgtgtgtgtgtgtgtgtgtgtgtgtgtgtgtgtgtgtgtgtgtgtgtgtgattgagattgacatcaacccccatctagtgttgaggtctaagaggcgtgttgcctcggtggtggttgtccatgacccatcaaatcaacgtttcttcaagaggaacagactgtcattcttttcatctctcttagtagtaaagaaccatttgcctttaataatgaaggaagctacttaaatccatccccagagccctcacaagcagggtttgttcctgagttaattgtgcttgacttatgaagggtttctaatgagtatgtattttaacaagtctggcattgggattgggaaacagtatcattaaccagtgctggagaccagtggttttcttcttcttttttctttttgttttgcttttaagtcacagagcccaatatgtaaatgaaagcctggaaggctgcccacttttgctcctgagggcatttctaagaaagtggggaaatatagtttgcaaaacactgcagttggcttcctgggttgtagcaatctttttctgtttaggtctctgtttggggaaaaggattatacatgacagtgtaaataagcagccatgttataataaataggtttctactgtaataacagaacacttacctcccgcagttccccttttctaatgccgcccaagctgtagcagttgaagccgttgattgggactgactgaatgtttagggaacacagagctcattatttaataaagtgttgtaaccaaagtatgttcaggaagtgttcaggggattctgagccagtgatggtgctcttcagaacatttcagttaatacaaaatatgccactattaattcattttgtgcaaactccagtgccattttccacagagagcaacttgtatacatagttctcttccatatgccgtggcttaacctgatgtgtcttttttctccctttgtatcagggtctgagtatgacctgaactttatctttctccccctctaggctacagatgcacatgttgaatggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctcaaaacaataaaaaaataaaataaccagggcagaccaaagcctatacaaactcttggagaggtttaatggaaagaaagcagctttcaggtgttctaaggggctctcgttagattcaaccacattggccttgaataatttgctgtgggagcctcataacctgtccacttctccaaggacttcctagggcaagaattagattccttccccatccacccaaacccatgggccagtctggaccaaacagcccctcatggctagcagggagaatcccatggttgcagcgggctgggtgataaaccagcccagaaagaagcaggagctacgagccatgtcctcagactcccaaatgtgagactgtggaggcattagcaggtcacattgagaagctcagaaaaagaaatcacttataaaattattactactgctttctgacttaaatttgccttaaacattaagatcatagtttaaatctttaattgataatcatttttggatagcattttacagtgtacaaggtttttcgcataacagtgtttgaggtagacagggcaagaattatggcctcttgttttacagaggaagaaaattttactcagggagtaaaattccaagtggcagttaggattggagcctaagcctcttgatcctaagatcacagctatgctttgctccctctccacaaatattcctgtcatctcctccccacaaatattcatgtatacctttatgatagttacaattttcaagatgcatgtcatatatcagtagaaattatagagaaaacattcatctaaagcagcgattttgaaccctagtatgttccaggctcacctaattagcttgatttaatcatttcacaatgcaaacatacatcaaaacatcatactgtacgtaccttataagtacccacaattatttgtcagttaaaaataaaattaaaaacaaacactgatgcgctgccccacccttggagaggatgagttcatgatctgtgataaagcctgagcattgtgttttaaaaagttccccaggtgattctagcatggagtgggagttgagaaccactgatttcatgcaatgattctgaaacgtaatgttcatagcaatcaactgaagggcttgttaaacatgaggcttgtcaggccccatccccagagggtctgattgagagagtctacaagtaatggcagggactgaatgtttgtaacaagtccccaagtgatgccaatgcaggggtccttagaccattcttggagaatcactgtcccaggtgttcgtaactcacagttactccaagtgtgtaactcaaagtgtggtcctaggatcagcatcacatgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacatatctccctgggtctgctgaagtatccttagtccctttatcaataacagtagcggttgctgggtgcagtggctcacacctgtggtcccagctactcaggaggctgaggtgggagtatcacttgaggccaggagtttgagaccaacctgagcaacacagtgagaactcatttctaataaaaaatttaaaaatcagctgagcctggtggctcacacctgtaatcccagcactttgggaggtggaggcaagcagatcatgaggtcaggagattgagggcagcatgatgaaaccccgtgtgtactaaaaatacaaaaattagctgggcgtggtggcatatgcctgtaatcccagctacttgggaggctgaggcaggagaatcacttgaacccaggaggtggagattgcagtgagccgagatcacgccactgcactccagcatggcaacaaagtgagactccgcctccaaataaataaacaaataaatagaaattaactgggcatggtggtgcaagcctgtagtccaggctgcttgagacttccgccctcccttctgaggtgggaggattgctttatcctaggagttcaaggctgtagtgatttatgatcatgccattgcacaccagcctaggcaacagagtgagactccatctctaaaaaaataaaaagtaacagtagcagcactatcagctgctgattcttgagtgcttactatgtgccactgttctaagtgctttacatggcttagatttatttaatcgttgcaataaacttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttggggccctcagtgaatttccatgtgttctactctgccctgtgacttactggcaccaggatttgcaaatcagctagagaatgcctaggcttcagtttctctgggttctccatctttaaagctgaaccctaaaagaaggactgtgtattccagtggcccatattacaagtaagtgctctttacacctaggatcctggaaaaaggtctttttctagattcagatgaattatattaaagggcaatttccagtgatatgcccttttgtttcttggagtgaaggaggggaagtacatgatgaacctattgattattagattagcagggagctcaaagcttgtctgatgtcatcttatcttccagagggtaaatttaggaggataaatgacgagtttcagtagtcaaggtgggtgtccccagaacccatatctcttgactgagacttcagaattatttttctattccatgaatgaaattcagggagagtttgtgtgctggtgatagagtctcttccttgataaatgcacaaacacacaattttgcagacaatttcaggagggacacagactacaacttcctctcctagcccctctcccctctgtaagcccacctattcatcccatgttaatgtcttcctgcctaggctacaaatagttcatagtttagggaatagatgtgctgtctagtgtgtgagttccttgttatagccgctggccatttgtcctgatggtgatactgggttccttatctatacccgtgactttgcaaagaatatcatccaatccaggataaaccactttcaggaaattaaagccaaggagtggaagctaagtagggtgtccatggaacctggttacagattagattttcagttacagtactcacgtgcaaagctagtgatctggccctgaaatgagacactgggcccatgctgcaacttcagcgctctgcttttcaccctctaacccccatgagagtttcttctgaatgcagaatgttgttagcaagggagactggatacagaaaagaaagtgaagatactatatcagccctcttcccagaccaaaaactctagcctggcctgcatttgtgtttgtacccatctgtcttctactaggagaagcatgataattattcttttcatcaagctcctttcttcttcaaggcctaaagcctcaagtacattattatcttattatcaaacttgcccattattatatatccatgttgatctattatgttagttcctttttaccccctttactaccactctccttttgcccagttctttctgctctgttggatgggatggttcttttgagtattcctaactttcagactgagtggaagaagatagtaatgattctgtcattactggggtgtctagcctccattcacaaacactatattgatgttcttgggatgcagcttttccactgacacaccttgtacccatgtgtgctgctggaaaaaccttgttgtcaccaatgcagataggcttgaaaatctcactctttgctaattggcacatcgaaatgtgctagttgacctagaaaagttatttctgtgactggcaaattgggctattttaaaaagttatagtttggattttggacctgaactgaggacagaatgtccctttattatcctgagggttcttaaagcgtacaaagcttggtttcaaaagaggtattaattttctaaagaattgagtgaggcacaatagtgcctcaaccttctgcaaaggccagtatgtttctgatcagatgaatgcattgtgtctgaggatgtggggggtattgagatgagtttgggattcctggtccaaaccaaattctagggactatcctagaatatgtcaacttagtagctttattttaagactaagctttgagggtcttaaatccttgatgaatccagcctagatcacaccagtcaaaccacagatttttattgagcactttcctgtgttaagtatcatgccatgtgctgcagaagatacaaaaacaaccagtgtacattcctggtcctcaaagaacttgcagtttagttagaaagataaagtataaatgcctgaaaagttatggcaatattaaagttgaaaacatgaaaaaggaaaaatcatggttgggcatggtggctcatacctgtaatcccaacattttgggaggtcaaggcaggaggattgcttgagcccaggagtttgagaccagcctgagcaacatataagaccctgtctttacaaaaaataaaaaaatagctgggcgtggtggcacatgtttataatccaagctacttgagactcaaggctgaggtgggaagatggcttgagcccaggaggtcgaggcggtggtgagctatggccaacactactgcacttcagtctgggtgacagagcaagaccctgtcacaaataaaaaagtaaaacttacaaggcattcaggcttgactgctaaattgcagttgctctatgtttcaagaaatgggaaaaagattaatattagcattcactgagcccatactattttccaggtaatttacacatatattattcaattctcataagaaacccattttacatatgaggaaactgaggttcagatcagattaaacgacttgctcagagttacatcatttgtaagtgctaaagctaaacctgtgcactttgtaccttaatacacagcctcctggagtaagtggtctggaaaggcttcatgaagaaataaagcctgagccaagccttgagggatggttagaatgtgcatgcaaattgcataggaaggaggctgttcaagctaagggaacacatggacatggaggcagaaaatagtcaactaagtattgagattctgaagagcagggtgggagtcagggattccagttgtacacagagacattaccacttatttgcaaatcacaagaagacactgtttctgtcatgtctcttaacccttacagtatttagattttgtgtacatttcctatcttttcaacctccacaaataagaatttcttatgtgtggatgggactttggaatcagaatagctcttttacacatatctcaccctagtgtagttgttaaggggattggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacctcagttctctcatctataaaatgggggtgataatagtgcctatttcataaagctattgtgaggattaagttagttgatgtgtgtaaagcaaatagcattgcactgttagccattattagtctttgatcctcaccaaaaccctgtgaagtgtgtattagcatgtccattttacagacagagccttagaaagtttaagtaacttgtacaggggggcacacaggaagtgacagaactagcatgaaaactttggtctttctgataccaaaggtcatcataccaaaggaaggtttggtcttcttctctcctagttatttagattgatttttaagtattcagccatatgaccgccttttggcaaattttatacagtatcgattagcaatttgggggcttaattttacttttaggatttttttgttacagaaatagtagatgctcatgactacagtagcaataatatattgtatatttcaaagtagctagaagagaggacttgaaatgtttctaacacatagaaatgataaatactcaagggcatggataccccaaataccctgacttgatcattgcacattctatgcatgcaaaaaatactcatgtgcactccataaatctgtaaaatattatgtatcaataaaaggaaaaagatttttttaaaaatgagatatgtgaaatatagtgaattatttcagataagttctaggaagaaaaataatacatggtcattgaaaagtaactcagaggactataaagaaaaagctaatcattttaccagcttttagtcctgttgcctcaagggtaaattgtgttaaaagtatctttttacacttatcctttgcttgtacatggagattaaagattttcatatttctaggattgttggtttatttgggttccagcttcttacacacttggaattctacaaataccactccagtatatttctttctcttttttttgaagtctcagtctgccacccaggctggagtgcagtggtgtgattttggctcactgcaacctttgcctctcaggttcaagtgattctcctgcctcagcctcccaagtagctggggtcacaggcatgcgccaccacgcccggctaatttttgtatttttagcagaggcggggtctcaccatgttggccaagctggtcttgaattcctgacctcaaatgatccacctgccttggcctcccaaagtgctgtgattacaggcgtaagccaccatgcctggcccagtatatttctttgtttaacttaaacactagataatcagtaatctcttcaggcatggacataactcttttcatccatagtttggttggactatatattcatatattccttctattctctgtgggtaaggacagtgtcttttttctttcaagtgagcagtttaataggataaaaatattgcggaccactgacctacttcaaacccctcatgttacacaaaaaatagacacagagagatttgttccagggtccactgttagataatggtaagctgaagtacagacttagaattcccgtttgtttacttcaaatccaggactcttttctgctttgccattctcattattcccgagttctgaagaccatagtttccacagagtgcatgtgcaagtggattatcgctggacaccaaattccaaatgttcaagtacacatcatttcagtacacacacatgtggctagtgtcctttccaacctttgccaaagtaccacctcactttatgaggcaaaatgtgtaatggagtcaaagtccgaagaaccaagcagtagattgtagagcatggatagagatcaataataaatacttcaaagttcaaaaatggcgacatttgattcattgtgaattgacttgtagaaagccccattggagctgaggacaagtgtcttttgttttgtggctgcccctacatagccttgtacttagcacctggtagatatctatagatagaataaatgaattcatcagccaacctgaacctctatgttgcttagggaaattctggggatccctctcacatatgtcctgggatcttgggtgcaaagacagaggggtgatagataatatttttttccaggagaatttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacactcatttaaaaattttacatcattttatttttggcacctaataattgcacatattttggaggtacattgtgatatttagatacagacagtgtgcgaagatcaaatcaatcttgttagcatatctgtcacctcaagcatttatcatttctttgtgttgggaacattcaaatcctctcttctagctattggaaaatatacaatacattattgttaactatagccaccctacatggctataggacattataacttattccttcgatctagctataattttgtatctgttaaccaacctccctatctccaccctccccagcctctagtaaccaccattctactttccctttctatgacattaactttgttagctcccacatataagtgagaacatgtggtagttatctttctgcacatactcattttttaaaagcactccaggcaattccaatgtgtgcaaccagggcagctctgctgtacaccttgttctagttctgccctgccactggctggggcttggggctttgaaggatttaatttcaccatattaagtatcagtttccacatttttcaaatgggatttgtaaaatttaccctctctacctttcagacaagttataaagaaaagataccaaaagataacaatgaaaagataacaaagagctttggaaagttaaaagcactacacaaatgagcacttgccttgttctctctttgacttcagtcacaattttttgtaaagggggtttaattgacatataatttacaaatgaaaagtttatccttttcaaatatacaattcagtggtttttaatatattcacagagttgttcaattagcaccacagtctaattttagaacactttcatcaccccgaaaagaaattgcataaacattagcatcatccccattccttctttccttgttctggacccaggaaaccactaatctactttctgtctgtatggatttgcctattctggacatttcatgtaaatgtaaccatataatatggcattttgtgactgacttctttcactcagcagaatgttttcagggttcatccatgttgttgcatgtatcagtacttcattcctttttacggctgaataatattcctttgtattatatatcacattttgtttagccatttgtcggttagtgtacatttgggttggttctaccttttggctattgttaatatgctgctatgaacatttgtataaagctatctgtttgtctgctttggagtatgtacctagaagtagaattgctgggtcaaatgataactcagtgtttaaactttagagtaactgccagactattttccaaagtggctataccattttatatgtccaccagcaatgtatgagcattccaagttctcaacatcctcactaccacttgttattgtgtcttttttattatagccattctagagggtgtgatgtcgtagaggttgagtatccgttatccaaaatgcttagaactcgaagtgtttcagattttggaatgctgcactttgtacttaccagttgagcatccctagtctgaaaatctgaagtgcttgaatgagcattcttttgagcatctctttaatactcaaatttgacccagccatcccgttactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagctttaggagatatacctaatgctaaatgacgagttaatgggtgcagcacaccagcatggcacatgtatacatatgtaacctgcacattgtgcacatgtaccctaaaacttaaagtataataataataaaataaaataaaataaaaaaataaaatatctgataaaaaaagtttcatattcaggaacatttcagatttcggatttttgaatgctatttctctgataactaatgatgttgaacactttttcatgtacttactagctatttgtatgtctttttggagaaatatcttttcagatcctttcccaaattttaattgggttgttttcattgttcagttataattgttctttctggatattaaacccttatctgatatataatttgaagcattttctcccattctgtgggttgtcattgcatttgcttgattgtatcctttgaggcacaaaatattttaattttgataaagtctaatttctctatttttgatttggctgcttgtgcttttggtatcacatctaagaaactgttgtctagtccaagatcatgaagatatatgactgttttcttctaagagtttcatagtgttggctcttacatttaggtctatgatccattttgagttaatctttatgtgtagtgtgaggaaggggtccaaattcatttttttcatgtggatatccagttgtcccagcaccatttgttgaaaagactcttctatccatccccattgaaatatcttggtatcctttctaaaaatcaatgaaaaataaatgtgaaggtttatttttagaccctcagttctatctcatttctctatatgtctatccatatgccagcaccacactgtcttgattgctgtagctttgtagaaagctttgaaactgagtgtgcattgtaacaagatcttctggggattagtgtgtgtgtgtgtgaatgttgaaaagggctggaaagcaaagttgaaagaaagcaaaatgagcaatatagtgttcagatgataaggcccagggggattgactagcctgaggccacatagccagtgattggcagatcttggttcagcactcaggtcttctgacttccacatcagtgctctttccacctcccctgttgcataagtactgaatgagatgcctttggttaatggacactctgagcaagagacttcagggttatttaagcaactgaactttgctcaatcgcctcatctgtacaacagaaatattacctctatcactggctgggcctggtggctcacgcctataactgcaacactttgggaggctcaggaggaaggatcacttgagccgaagtgttgagaccagcctgggcaacaaagtgagaccctgtctgtacaaaaaataaaataattagccagccatggtggcatgtgcctgtagtcccagctagtcagaaggccgatgtgggagggtcacttgagcccaggaatttgagaccagactggccaacatagtgagaccggtctctaccaaaattttttttaaaaaattagccaggcgtggcggtatgtgtctgtagtctcacctacttgggaggctgaggcaggaggatcacttgagcctaacagttcaaggttaccatgagccatgatcatgccatacactccagcgtgggtgacagagtgagaacctgtaataacaaatggaaggaaggaaggaaggaaggaaggaaggaaggaaggaaggaaggaaggaaggaaggcaggaaggcaggcaggcaggcaggcaggcaggaaggcaggaaggcaggctggctggacggaaagagggaagcagggagggagggagaaaggtacatcatagttattatgaggattcaatgaaataatcctttgttgggtgccaactggcaagatgaattcagttttccattgcataaaaagaatcggggggtaggcagagctcctcctgaggcccatctcttacctcaacaggtggcctgccaacctccccttaggtcccacacgcctaggaccttgagtggagtgaactgagactttagggcaaactgagggtttctttagaaagtccaaggaaagagtgatcacttctgggtcccggtactgcatgggtgccagttgaggaagctttggtggtaggatccggccagaggagctaacgcaggaaaggagtttggggtggaaaaacttcgtaagctaggaggtcctatgatgtagtggataagaacaggagtgtatgtatataattttatattgtagaaaattgaaagcatacacaaaagtagaaaaaatgttccctaatgcatctgtcacccagtttcaatgattgtcaccacatagcccatctttttctttttaacaatacacctcactccaccacaaatccattccacccccaacacaaacacctatccctggattatttggaagaaaatctcatgtaattttaactgtaagtatttcattatgcatgtctgaaatgtaaggacacagtaaaaaataaacattacaataccattatcatacctataataactagcaataattccttaaaatcatcaaagatacctagtcagcagagcccaggcttttaatctagccaaatcactgttccagtcttccttctacagcatcaatagcctgtctcagagcctgttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagcatctcctgctctgggacagttacagactgttggctttagcagtgatttggagagtttgtgcttgctttggctgggaaagagacttatccatagcctactgcctttcaggattcttttctaaggggatatcaatgcctgctctccacgtctattttctcgaggcccacagtggagcacaaacaatggaaacataggaatccatgcagagggctttagcgatctcctgggacactgcttctgtcctgtcttttagcccttatagtttatagtttagattttacatgtgtttcctatcttttcaaccttttctaataagaattccttacatgtggatgggacttggcaaccagcaaatctcaccttagtgtagttgttgaggatgggttcagggattttctagaaaataaatctattttctaggtttatttcctggctgggccactcctgtgtgtgtgtgtgtgtgtgtgtgtgtgtgtgtgtgtgtgtgtgtgtgtgtgtggtgttggtgggaagaacataaggttcttcatggagtgggtgttcaatatatgactgattgaagagaaggtcaatttgtaggtcaactaggtggtgctgaaagaattgagcaactcccatttgtgccttatgccacatgcactgtacataactgtgtcttggtctccaaactaggccagaggtcaactgtaacttgggccaaaggtgccttctgtttccagttttgagcaagggaatggcagctctccatatggagcagggaccagggggtgctgttggcagatgcatggtgagagctgtcctgaggaagtaccatccagagtctcgtcctagcaaggtgttttagtgtggttaaagggtcactcctggccgggtgtggtggctcatgcctgtaatcccagcactttgagaggctgaggcgggcagatcacctgaggttggcagttcgagaccagcctgaccaacatggagaaaccccgtctgtactaaaaatacaaaaattagccgagtatggtggctcatgcctgtaatcccagctactcgggaggctgaggcaggagaatctcttgaacctgggaggcggaggttgtggtgagccaagatcgcaccattgcactccagcctgggcaacaagagcaaaactccgtctcaaacaaaacaaaacaaaacaaaacaaaacaaccacaactcaactcctgcttccaaagatggaagtgagagaagattctttttcctttaactgagtgggcccttagttgagatatacagacatgttttaatttcactaactcggccccacagtgtaggagggggaaaggaacagcaagtagtccaggtagaggaagagctagggtccccacactctagccagaattgggggagctccaccttctctgatcaggggagagacaggattcccatcacctccttccaataactaaaataaccacagcacaaatatgtgtcctgtatcagcaagctgccattgaaagagggccatggaccctgcgtatgatagagcatgctaggtgcactcatggtccttataaaagcagccaggtatgcatgggctgggccctgcatgcacaagttacccattggtccactaaacgtatgttcctaaaacccattatggtcttaagaattcagactggcatggatgcaaaaattcagataacccctaagtaataaaagtacttatttttctttagaacctaagacctataagtctcaactaatttgaagaatactctggtgaccaaagggagaatgcctcttcaaaagattgcttttatttggaggttgcaggccttgcatagggtcgttcccccagcccccggggactctgttaatgaaggggtttgggtagggcttgagcctctgctccttcaacatttcagcatacacacaaaagagcctacttctcagcacagatgtgactactatgtgtccacttggatgtcacatttcagggaaggttcattcataatacaggtaaaatgttactatattttatcctctgttgttgctttgaaaagtcagtggtcagcctttttactcctttgaaagtaatcttttcaggtcacttttgaggtttttttgtttctttttgtttggtgttctgcaattttgctatatgtttcagtattgatttgttctttcttattctgtttgggagcctttgggcttctggtgtgtgggtatatatcattcatcaggtttcagaacattctcagctgttataacttcaaactctgcctctgttccattctattcttctgggaccacattttagagatatgttagtccatcttactgtgtcttcttatctcttaatctttctttgatattttctaatttgtcttactgtattgcactttggctaatttcttcagctgtatattccagtttattatttatctctttagttagttctatccattgagtttttatttcagttattatatttttaatttttttcaaacatacaaaacagtctgtaggtaataattttattatctgcagtctttaaatttctgttttcaggattcctggcttgtttccttgtgtatttaagttttctttattttaaatattattatttttgttgctttactgtaagttgcttattttccttgggattttatttatgggtagtttttgactcctggtttcctgtagaaaggatctgtcttcattcttgctaggcacctgagagctgccagtctggaatcatgctaaatgaattctgacctcaggttttttgattacccaagtagtatacattcacttttcaaatacacatgatggctggcttgccgttccaagtttttattggagataacctagttcctttccctgctactccaactcagtgtaaagattgagagtagattttccttatcgtcctagggggcaggagtaatttgtatttctagtacacgtttacactgaagtgtagctttttggggtcccagctttatgagagttatctcctatcagactctttttgggatatcttgacctttgtcccccatcccttatgccctgtgaagctatgagaaatcaaagctcaagttcagctggcttagcaaatctactttgggtgaaaattggatgccgtatcccacttatgtctctgggttcccactttcactttttttctggctagaaaattccttgtgtatttgacagttcatagattgaaaaataaaacaattttaaaaatattttatccaggacttttggatgttttcagtggtagatttgtttaagaactagctttttatatgctcagaaatgaacatctggatcttgttttccaacacttttatggctgtgtccttactttcaggagcaaccaggaggacattctaattctattccttggttgtcagtgctctcctgaaatatctctaaataagttgataaatacctactgtgtgtctagtattgtgctaagttctatgaaatatcgggaagaccatgtagcttctcatgtagctaacagaacattggcagtagtggccttcagcccttggaacactgatttaaaccatattttcatttccaaacccttttaagccctagaaattagcatttagaatgatgtggttgtaagactgtaaggtacataaaggcagaggccatttgtatcttgtttataatagttggcacatagtagatgctcaataaatactgaatgaatgagtatctgggaggtcatggaggcagattccaatgctgatcagttcccatggcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacatgtaggtagtataagtcggtgattaagaacatggactctgaagtcagactgcccattttcatcctggctctgtaagttacgttgggtcagttacttaacctctttgtgtctcagttttcttaggttctacctatagagttgtaggaattagctactacatactaagtattaagacaatgcctggcagagaagtgccatgtactaacaattacttattatttctattattattatctccgttgttgttttgaacaccagtcacatcataaaaaatacattctcctgggagttatttgtcatttctatatgaaaatattctgagttttcatacttaccccttaggattttggagcctgccctactggagtatttctccaggtaggggttgaatacctctgtatctttttttttttttttagggaaatatattaaaatacaggatgctgggccccatcccagttggtccaaagaaatttctttctctgaaactctgtgatgaaaataaagattctacacattctctgtgtgttgggttagccaggaactgctgcaggtttaagtttaccatccttcagtgctgatggaaaatctgggagcaggcttggagcctgagaagaaatagagaattggagagttaaacagaagagaagagaagaaagaaagaaatagaaagaagtgaccagagtgtactcatgtcaggaggtggtcaaatcccatccatctctggtggcctccaggggatatgtgacatttgctttcccttgatttagggatttatgaacctggctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggtagtacctatattatggcagctaggtagcgtaagtccttccgttttcatagtagactttatttcttttccatcagggagcagcctgaagtatggaacagacaataatggttaagatgatgggttcttgagccaggttccctgggttcaaatgccggctgagccacttaataaacccaagaccataggcaaattatttcactgaaaccctatccctttttcttttaaaatggaccttggatacacataattggagtaatcatatttctaatccttgactcatttcatgctgcaccattcgtccatgtatagcctgctttaattttatttatgtgtgcatttacttttttatggataatatgacaactgtgagcccaacttaagaattagccacattgatgagaactcagtctgcctgtgtgctgctcccccaatcctgctctctacctccctctccaccctgaaggaatcgctggcctgaattttggttattattctttttctctttttgaagttttatctctctcatatgcacagagatatttatattcatattgatgtagctatggatatatagatatatacatgtagatatatcttcctaaataagatattacttggttgtttttctggccctcataaaaagggtattatgttttaggtagttttctggtacttgcttgttttactcatcattatattagtatgattcattcctgccacagagtataactgtagttacaatttcactgtggcataacatttcatgttaatataccacaatgtatttctccagtctccttgagatgggtttttggtcatttccagtattttactatcatgaaaaattcctctgttcctcagttttctcatcttcaaattggggaataaccataggagctaccacataagggtgttatgaagataaaaggagttaaagtgcttagaacaagaccttgctcatagcatattgttggtccgtgtattggtttgttagggctgctatgacaaatatcacagactgggtggcttaaaaaacagaaatttatttcctcacagttctggaggctagaattctaaactcaaggttttggcagggttggtttcttctgagggcctctcttttccactggtgagtggctatcttctcccaatgtctttgtagggttttttcctctgtgtctgtctgtgttgtaatctcttcttctttattgtttttttctttttagttggagtcttgctctgtcacccaggctggagtgtaatggcacgatcttagctcacagcaacctccacctcccaggttcaagcaattctcctgcctcagcctcccgagtagctgagattgcaggcacctgccaccacacctggctaatttttgtacttttagtagagacagggtttcaccatattggccagcctagtcttgaactcctgacctcaggtgatccacatgcctcagcctcccaaagtgctgggattacaggcatgagccaccgcgccctggactgtaatctcttcttatgaggacactggtcatattggattaggacccacccatatgacctcattttaccctaattaccttttttaaaggcactatctccaaatacattcacatactgaggtattgagggtgaggaattcaatgcatgaatttggggagagacacaattcaggccataagagtcagtaagtattcattatgaccatcattctcttcaccctcctccttatcattaaagctcaagaaaatgcagcagacttagttatgatatatcccctaggaacactattatgtgaactattattattatccttaggcagaccaaacaccagagcttccttcccggccttttcagaaatgactttggatacttggataccagcaacaagtactcaaaaatggtaaattgtggtttcttaagatgataggcagcagctccttaagtcagttagatgtgggaggaggagagtgaggaggtttcatttccatcttggttaaaagaaacagctaagtgagctcttgtagagtatctaatggtatacagactcgaaattgccacttggtaaagttctatgggttttcctgaaagaggcaggcagatctggtttttcaaaccaggaaatacacttgcacaagtggctgtgccaccagaacaaacagcatcttttatgggctcaaagtatttgacattagggagctggctaggggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaaaaaaaaaaaaaaaaaaaaaaaaaggaccagtggctgcccccccgcttaattatgcccccctgccctttccatgtcagacgatgaaaattagatggaatagcatgtgcctggcagggctgtgggcatctgtccttactggaggtgaggtgaggagtgggagtagggtctcgagggaaaaatacaatgagaacaagggatttgggggtctatggatgccccctttacacattattttcttaacaggctgtgattctccaaaggagggaattcttaaaaactagaacaaattaacactaatcatcattaataatttaatgcatcctcttggataaggattcctgtaatgtagagatgtaaagaatgtaacataaaagttcccacctcctactccccagagagaattgctgttaacagtttggtgtacttatcttttaacttttttcatcctttaaaagaatttagctacatgattaaaaatgaatacattcatttgttataaaaaatatatatatacaagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaaaaaaatcaggatccagtgaagtttcaagtattgcttttgattattccatctctttactggttttcatttttttaacctaagaacggtacccccttcttcatttatgatactgaaatttagggagttattttgtagaatgtcccacattctggatttgaatgtttccttaatgacaccttcttatttttaatggcaatgtggtattctgtaccatgaattcatcgtggtttttttaactagtcccctattgatggtcatttaggtcgtggcattccttttgtggctcctctcacaagtggtatttcgtcctaaggagtttgtggccccagtaggccacagttaaagtctgtggtcagttaatgaagataaagtgttccaaaacctaacttcgctggcaggaacattatcaagggcagttgtaaactgtgaattgcatcctttcccctctaaaggagatggattatcttttttgattccctgatttattttgagaggctgtagtctagggctgagctgagaccagggttctgtctttgtaactacctattctcacttggcacctgatcattaaccatggactcttctggtaaggccaagtcacctgaggtatggtgtgagctcccttaatttgcagtgtgcagccctccctcaagcagttattctcacttcagcctgttcttccttcctcatctcctgggatcccaaagctaatatttccatctgtgctttgggtcctattccctcccacctgcttccagtcctctcgctgtctagtgcctcctgccccttatgcttctccagcatctccctgtccactggctccttccttcagtctatacagaatctctcctgttcttaacagttatttctcaatattgataccaccctttagttatagttttcatctctctccaggcatttactcttctcaaaagattactgaggaccaggggtccaccaaatggggtgcaagagatgttccattgggtgtgtgaagaaaatgttagatttctattctaataaaatttcatccttttaaatttccatgtttgtgtgtcctgatgtacatttaggtgtgcatattttataatttacagttatacatgtatatcatttgccttactttcgattcttatcatcctctctagcccccttcagatccacacccacctacattctcaccgatttatgagcttctctcccaggcagtcacactggcatcacaaattcagcatggccccagcttcttttcttgtacctcacctcctccaatctgcaccctagactgtaggtcccaacatagggagaagccccaacatcccaccatccatctaagccatagcctgtgagtcatcttcaacttcttatcttctcttacttctgcacaataccctgtccagtcaattaattagtcctggcaattcaacttccttaccttctctcaaatctgcccatcctctcttctctcgctgtgtctgcctttgtttaggcattgctatcgccagcccctaactggtccctctgcctcaagtagcaaaccctgcacacaaccaccaaaaggagctctgcaaaactacataccatgcatgcctctcactcacttagaaaattcaaaccaaagccaatacatgatctacagggcctcccatgatcttttcctgcactgatattcttgccttatctgttagcctcctcaactagactatgaactgttgtagggcaggggtccctaccctgcaagatgtcttcattattgccacatagcaagaggcaagcacattacctgtcacctaggcgtgccttaataggtgtttttggtcaacagtatgaaagtgagaataggactgttttgggtaagaacaggagagtggagttgaccttcctttgagaaataaagaagtttccagtgagaaactctggcctatagataggccaaatgaatggactgatgtggggagctaaagttaccctggtagtcatctgataaacatactaatgtgtgacttaggactgtgggacaggcccaggtgataccatctcttcttgctaaggcagaatgatgaaatgaaaccccagcttttgacctagaaagatgtggcattaagtcttactgcctgggatggaaattctggctttcctggttactggctggattgatgttgaaaagggggatagtgattataacagccagcatttaatgagtacttactatatgccagcactgggccaaggattctacaggtattatttcaccacaactggatgaagtagatactgttattcccatttatgaataagtcaactgaggctcagcaaaattaaatgatttgcccaaagttgtatagagaataaatgatggagacagaatttcaatctcagcagcctgactccaggctggagataccgattgggagtcatcagtatacagatggtatctagagccaggaacctggataagattacctagtgagtgggagtagctatagaagaggaacatggaattggttcttggcccctgtagtatttagagatgagggacataggggaaattcagcaaaggagattgagaaggaacgccattgaggtagagaaagaacagagggtgatgtgcgagaatcccagcacagaaagtctattcaggatgagggaatgatcaactgcatcaaatactgttgatggaccaagtaagatgagacctgaaaatagaccaggactagtatttctagttgtgcaggttgttaattgcataatggagtgagtggtatctagaatctctctgacaccctggcatggggttgagccttggcagaagaaggagagcctatttcacataaagacgccatgtgggctaacttccatccttgtgttgcctactggaattagaaacatggaggtcattggtaacctcaacaaaagcaatttgagtgaaatggtaggaatgaaaatgtgattgaattggatggaagaatacttcagaggaaaggcagtgatggcgatgagtagagacatctctggaggagttttgctgtaaagtataaaggaaagcagagaaatagaggtggaagctccattactaccacaaatggaagtgaggtcaagagcttttgtttctttagatgaaaggtattttagcatgtttgttttctgatagcaatgatccagtgagaaaaacagacaattgctggtatgacattcttgagtaggtgagaaaggataggatctagtacaggagtgatggtactagccttagccagcagcacaggtgcttcctgcatagtagcagaggaaaaagcagctgtggggatgggtgcagggaggagggaggtatggaggtgggagcttatgcatgttatcttctaatggctctccatgccccctcacctcactgaaataggaaaccatttcctcagctgagagcgaggatggggaaggtctgaggaaagcaggagaagttgtgaaatagtggcctgggagagaggagagtaaatggtcttgggaatatagtgagattgtagagcagcatgaaagtctggcactaagtttgttgtcatgaatgtaaagggttaatagcatggctttatatttttctccagacatgtttgcttgcatgggtttagggatgtgaagtcagacagttggatttagccaggaatgtggtattgcaaggtaagtaggacaaaaagagagagtgtgtcaggagagttgggaatgtactgaaggaagtgatgggccttgaactcaatgctggtgagcatagaagtgaggacatgaggttggtgagggggcagtaaaaaggtggtaggatcaagactgtaggtcctggtgaagtgggaaaattgtgagagtagggatattagagggagtgaattggccagacacaaggtggtggctggatagtagggtgcatgacagaggttatggagagatcacagccattaacagtaactggtgtgaccatgtgaaaaaggtgtgaggtaaaatggagaggagaccttgaggagcatggagggcaaggcattgagaggccagggtgttgctaaatattgataccgcagagattttgacaaaggaatgttggaaaggcatcacagggaggggaaaggcaaaaccttcaaggactgaagaagggagggtatacatggagggggccgtaaatccgtaaatgactgcaacagaaaggagtagtgggtgccatagtctcaggacatgagattcaaatcagcagagtggttagcaaggaggcagagagaatggtctggaagagacagcaatttagaaacatctgtgaggcacagagaggcactcccttggcccagttgtgtaaggttatatgagaagaaaaacccccactacttgagagagctgtcaggatagcagtgtcttcagagaggaagaactaagtttttcttaaagaaaaaaggtgaagggactgctcaggtgactgatgtaaacagggaagtaggggcgtggtgggatcagtggtctccatggcagaggacagtggtgtagctgtcagggttgtagagtgggaggaaggaggttgagattctttccacgaacagagtccacgcacctactgtttcagacagtctaaactctagagccctagagaactttaccactctggtcttttgattctaaaaaggatgttgacttgtgagaaggtagttaatgacctgtgttgcttaaagcatttttattacttttgactttaaattgcattgatgcaggactttttgtctataacctcaggattcctccagctgaaaaagaaccaggctatgtatattagagtggaattccaggtatgagttctctagtgtgtagaaatgaattaaccaagtggaactctttctagggaagtatggcatttcacagatattacttgtaaaatggggaaaagagggtcaggggaggctcgctgagaaagttcccagaactcagcccagactcggtgctcagtaaagaactgtcttagctgggcatcatggtgcatgcctatagtcccagctacttgggaggttaaggcaggaggattgcttgagcccaggagctcagggctgtagcatgccatgattgtgcatgagaatagccactgtactgcagcctgggtgacataatgagaccctatttctttaaaaacaaaaacaaaaactttttcctccattattgattgccctttccccctgtccctgtgcctattgctgtttctttggatgttatttaatttctctgtgccttagtttcctgtatgtcagatgcgcatgatcatagtccctacttcataggaaagttgtaataattaaatgagataacactatgtgtattagtccgttttcatgctgctgataaagacatacacaagactgggtaacttataaagaaaaagaggtttaatggactcacagttccatgtagctggggaggcctcacaatcatggcagaaggtgaaaagcacgtcttacatggtggcaggcaagagagaatgagagccaagtgaaaggggaaaccccttataaaaccatcagatctcatgagacttattcactaccaccagaacagtatggaggaaaatgcccccatgattcagttatctcccactgggtccctcccacagcacgtgggaattatgggaggtacaattcaagataagatttgggtggggtcacagccaaaacatatcaacgtatagaaatatttaacacagtacatggtacataatataagtacttaaatatgatttgctattaaatgacaagtggtaagttcttggctcccattcaactctcttattcttgccattatgtttcttcttacttcaccccctttctcttacatcttcttccctttctctccttctttttccacacttcctccttaacctatttcctctttccctcccctggctttggttgcagtggcatatgcacctagttcagtactctttgtggccccctgaagtagagaagtcttagagtaggggtgaggcagccatcagaggaaggaaactgctggtggggacagtctcttggccattccatctgaagtctgtagtgtagccatggtggctgcagagatgcaaagggccagtgacaagaggctcaggagctgggaggcctatgttgcagggcaagtttggctactgtgtgatgtgtggctggggcaccagacagtaggcagagcatgctatgaagatgaggatcatttgaacaggaagggactgggctaaatcaccatgtggagggacgagtgaggacatgtgcatgtcctgcccctggtcctgttgctgataccactatgactactcccattcataagggtggctcctccccacggggcatctcctgtcagtcggccttctgtgggagggagcgagtgagcaaaggatagctgagtgtgctggctaagactataaattctagagccaaactgcttggatttgaatcctggctctgtcaccgaatgagaatgtatccttgagtaagttatctaacttttctgtgcctcagtgtcccatctctaaaatggatataattggaacaatacagttcttatgaggatttgtttaaattaacagtttacaaagtgattttcatagttcatggcataaaagaagtacgatgtgagtttttgttatattttaaaaattttaaaaatcatacaacaatcttagaagacttactttcattttaccgatgccaaaacggaggtggagaggttaagggccttggccaaggccacagagctaccgagcagcagagtcaaatctagaacacagctttgacatactccaaagtcctagcttgtaactgcaatgcttaactgcctccctggacattcaggtggagactttgctttctaggagagctgggaggcagggtgaggcaggtgggcaatgtgagtcaaggtgggtggtcagcagttggagtctgagaggttgggagaagtactgcttgaggacacacctgggactagtggctgcatgcccttggcccggctccttggttggggagagcagcctggcttcccaggcccatttcagggacaggtcaagtcccttaggtgcatgaaggtgctgatttcagccagagagctaagccttcttgggactttttccttccttccctattttccaggtgacctcagtgaagttaataacccttttgcacctcagtttcctcatctgtcaattgaggataatactttacctgtctgcttcctgggtattttgagacattgagtagattgtggatgtgaaatcatttgaaaagcataaagcagtacctaaatttaagatactagagtgatctcagaccacattactgtgagggtccagtgtagatctctcaggcctctccatagctaccttgtgctgataatgcccagtgtccaatttcatgaccttttccagctggggtctacagtgatacttggactcttacctccttttctcagtttttacatttcccttggtgagtgtaaagtaatagttgagcagcatgtgggtccctgggaaattattttccgtgtggatttttatttttaagagccagagccaacgtctgtgtccagcctccacagttgtcccagctcccattctgggagctctgccatcttcttggtttcagcccttggcataagacagacctgggctcctgtggctggggagcctgtaactgcctcctctcattagcagacagtcttggttatgtgcttgccctgtggggaacagggaggcagctgaccctttcccctgggtgcctttgtctgtcctggcatactttggggtgtgtgtgtgtgtgtgtgtgtgtgtgtgtacacgtgtgtgtgtatgttagagattctgtaagcccaagaggctaggcctcttgtcagctgccaaagttcttttttccccagaattgagttagccacccaactgtttccattctctgcccgctgcgaagctctacagcagggctgctgtggcaggtcaaaacatgctctgctttgagaatacagagattccattttgagagagatgggaaacaggagcgagtgagtgggtgtgttggatgtagggaaagtgaggacattctttttggtaagctgtgccaaaattggcccagaagcttggtctaaactcaaaagtagggctaatgctgggctgacacccaaatatccaatggggaaagtttattcttggatctagaccctatgagacctagcaatcatttttttttctcatctggaatatggggataattctactccatatattcttcatgtcaaatgagaaataaacttgtaaatagtctaccgtctagtctccaggagcaggaagtgacataaggttgtgattcttaaagtattttgcagaatacaaactgttactaaaaaaagaatcacttgctaaataagtttggggaacactggataaacaatggcatgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatcctcggcctggtaagtttggttatatccccttctatcccctctgtttgcagttctccataaatcttggtaatcctggttggtgctgacgtatcactttgttttgaaaatgcaagatgctaaaggccaggatgtcagattgttgtgtctggattgctgatttatgatctacagccttggcctctccaaagagttttctgagtctttcagtaatgactgtttctttcatccctggggaggcaaggatgcctttcactcatggccacttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaa

SEQ ID NO: 4914 - DNA, 174670 bp, human
aagttgctagctgggggcagagacggccacgcggttgcaggagtaagagatccctctgtggcgagtgcgtgagacgaggagtccggcgtccctgccatccccgtcgccctccccgcctgctcggccccgctagctcctctccttgcctccgcgtgtcccctagctctgaccccttttggctcccggttcgctgccgcagcactgccgggtctccttggcccccgccctgaccctttcggcctccggcttcccctgacccctgcttgcttcgccactgccccgttcccgttttcttccctcgctagttacccctcccgcttcctaattcccggtgcaattgcctctttgagacctcttttttttttttttcctctccttccttttagattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaagtgataagagtcatttatgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctgaaccctaggaacgactggcactcaccctggctgcccctcccttccagcccagcccaaccctgccgtgccctgggctttcacaagcaggaattccagccccagccaggtgccctttctgaatcacatcagtggaccatgacccagctcccttgccttctgtggtagttaatttcccaggggcctggtgacactctttcctggaggtggtcgcataaactttctcatctacactgtggtactttggggaaatacttttacaggtttctcttaatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataataccttgcatttatctaacaattactgtttataagatactttcatatacattgttacttttagcttaggcctggagaaagggatgttaaaatgtttcctgcaacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttacccgcttttggttcactgtttgattttcttacttcctctctccttgctaaaagtgtagaatgacacacactcagaaagtcctgagctttttgtgaaaccccttgcaactcactgaatacacactgttgcattccggttgttatgtgatgaatttgttttagagaagacctgatggatttgagaaacttggctttctgttttcccccttgacttcacaccagacacacctcctcattctccatctgttgtctggagcactgattatcattcctgcttggaattgaagttggtgggtaatgggtacaataagggatccagccatctgctgacagcttatcagatggactgcgtcctgtgtcatcagtccagggggatacaaggggatgatgtttatatgggcctcactagtgaggcatgacattcctttttagtttgtttctccccccaaggaaatttgcagagaatttttccatctttcattgttacagtcattgggggtgtccatataaagagaggtgctgtggattggtgaattaaacaacccacaggcagccccaggatttaaaattatgatgctagttttgctcatggcttgctacaggaacctcagcaaactatttaaccttttcctatctcagtcttctctgtgaaacgggccacatggaaatgaagcatttgaattctctgaataattatgtggtcacttaaacagagaagctgggcaaagctggtcaaagatggcagatgaccaatacagtttcaacttcagactcagaaaccgacaaagctcaactccttatacctttcttgatagcttctagaaggcattcctctaatcatttttgttacttttctctggatccttgcctgtgtctggatacctttctgatgcatggcatataaaactggacactaactcttaccagaggtccagcctacaccaagcagagaggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcctttgacctcactttgagagatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaatgaagtgtggtgccatctttctacctttctttttcatatctcttcttccctgtttccaagtctgtccacctgatccaccccacacaagttccaaaacaatcctttctataattcaaaatgcccatctcatcagaggagatgatagccatgggggattaggaagaaagcagttttatttcagaggttcatactgaaatgtgagtggacagactccactgggcgtcagggagaggatgagttttaaaaaagggccttgttaccctaacattatatctaattggtagactgtgtctagtgtttttaagcagatgtcctttctcatgtgccttgctcaggttttggcctcttctctcccgctaaagcccctgatcaggagaactggagttatccatgccttgccaccctacatgctgacccccagggtttcatattaatgtaaatctccctccacagtgcttggatgcagcagttaatctgaaggcctggcgaggacccctcttctgggcaccagtcagtcctctgtgtttactcagctctttcctggctacacagggcagcgcttgcacatctgtcagttcatgggcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctccttttcaagactttgctctggggcctcgttttcaagactgaggtctggggcctaagccaccaatcactagagaaggatccccttaagagcagccttctggggcctagaccttgatcatgtgatttcaggccttgggatgtggggggtgtgctgtatcctgccaaggccattggaaggcctctgggcatattcccaagcattgtgggtaagaaggctgtttcttagtcttggaggtgggagaattgagaaagctaaggtcatgttttctataacctggttcctggaagaggagctggtttagagggcatttctaaacaaacagcaacccaaataaacagcagcgcttggaaattagttatgaaagttcacacattctaagacctagggaagattgtaacaaagggtcctcttcatatcagcacttgttcattgttggtttgcatttgttaagagtttccttttttaagttccaggaacttgagtgtgtgtgtgtgtgtgtgtgtgtgtgtgtgcgcgcctgtcactttattctctgcaccctgcaggaatgttgctcagagtcatgtgcacaagtgcctcattatcagcagcgctttcacacttggtcccttgggctgccactgctactggctgctgcttcatgtgggtatttctacctatttcctggagccccagccccacagggaatgttggcaccctgaggaaagggaccgcctctacatttggatctcccttctgctgcagggcagctgactttactctgctttcaagttcacctttcctcagaatagccctgcaagctagcaccaagccaaggttatgtttccttgcttgcatgtggggtttctggccagtcagccaagtgaactgattgacccccagccctgtggggaatttcaggggggtattgtcttggtcatcggagtcaggggtggcctttaggccaaggctgcattagctttgtggagaagaatgtgaagcccgccgtgtcacagggtctgctgaccggctgggtagtgtttggccatatctcacagccagtgctgtgtttgctcagatggacgcacatggaaaccaggctaggatcatcttcccaaatgtcttactccctgctttgggtctgtcctgaaaaacaatttgcaaagtacattgtggtctgcacctgttgttttttcatcccccttttccacagtcagtttgcagtgaatggaggattaatcctggctcttgccacttgtattttctctttcccttctttccttgacgttgggttcttgcttttcagttataactgtctgtggacattaaggacagctggtgcccctgatcatttaggacctcccttaggcctttaaaacgctggaaatgtgtaacagggccggatgggcaaaaaagagtcgaatttaggagaaaactcactataatttctggttatctttgtacactctcagaaaagtgaggagtggtagtaataacacttgtaacatttttgaatacacgttaattatgctttaggcatggtgcttagtctactgcctgtgtattacctcatttgcagccttccagaaaggttgttttttgtttcatgtaattttttgtttttttgaaacaacgtcttgctctgttgctcaggctggagtgtagtggtatgaatatggctcactgcagccttgaccccttgggctcaagcgatcctcttgactcagcctcccaagtagctggaaccacaggcacgcatcaccacgcccagctaatgtttttgttttttgtagagatggggtcttgccatgttgcttaggctggtcttgaattcctgggctcaagcgattcttctgcatcagcctcccaaagtgctgggattataggagtgagccaccacacctggcctgttttatctaattcttcttttctttgcttctagctgatttcccctttggtagactataggcactggatgttctagctgtactttctcaggttgttaaaatggcagagtgataccaaatcagagctgaaagaaacctctgagaacaactaatttgtttctttttcatcccttgttttccagatgagcaaactgagacccagagaggtgaagtgatttgcccaaagtcacacagctaaatagaagcagagctgagtctcctgactcccatttcaatatctctctataataccacacatggcctccttctatccttaaccttccagcatgaaaggaactagacttttcttcttgctcactattagagaaatggaaatcttgtgctttttgagcatcattgtttattgccttcttgaaagtgaggatctcctggctgcaggccacctccttcctttctttctttctttctttctttctttctttctttctttctctctctctctctctctttctttccttccctccctccctccctccctccctccctccctccctccctccttccttccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactctatctactactcgaccctttacactactgccagaatgatacaagtaaaatacatgttggatcatgccattcccttcctccaaaacctttgataactccttaatgccttcatcagggatggtaaacacatagatgcatacactttatattgtccctggccgactgtgctaatcaatcataggcacgctttcccagggagagtccaagtagatttaaaatctgtttagcatagcattctaggtagccacttatcaatcagtcagagctggtattaatatatagactagggatggcacatagataaagcctgtagagaaatcttaatctccttatgataggattcggtatcttctgtgattttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgtgtgtgtgtgtgtgtgtattgagtgatatctcaatatagttatttcctcctctttattcccaaagccttgggagtggactgcttgtaaagtgttggtcccatagcctgctagttagttgtttacttgtcaagagagatctaagatgtaagattctcaataatagtaactacctttattgggccttttcagggataggttttcagacttactctgaatcatacagcttgtaggatgggtgccagcactaggacccatatctgccccttttgagcagagtgcctggcatataggtatttgatcattgtcacatgatgtgacaaggagctttgtttctttgtgcaatgcttctttttattaaaaaacccagcggtggtaaaatctgacgtatttgaaaagtctggtgggagagaggtttgaggagaactgcctggcattcaaaaagcttatgatatgttagatagtgtgtggtgaatctagatcacataacatgtattaagcaattactccaggcctagtcgtactagagagatacaaaagtattagatgtggtttctgcccccagggaacttattatcaaggctcattaacagtctgactactgtattttcaggtggcaagtatgtacagaatttatgaccagaaaatgctagagatcagagaggctttcaagttcctgaagttcaagcccgtcgttttgcagatagagaaagaagcccagagcagaaagctgcttgctgaaggtcacaccacttgggaatggcagagccagggctggtgtatatggccttaccctttgaggtcctattacactctgttctgtcgcccttgaaggacaggtgaacctaatggcctgtgttaaaactttaacgatatgctttatgcctccaggcctccttatggtttgggggaggggaggttaaattttagtctttcttaaaaccttgagtgggaagggccagcactggttacctctggctcaagcccaagagttctaaagatggctaattttccctttactgagacaaccactgattctagtctaattagggcactttcctactcctcctaagggtctttcccaagctcagtgtgtttatgacttttctacttcagttcctcatttttttttttcctttttgtgaaactcaccttaaagacaagaggtgcctgtccttatgggtgggcctgagagttagaggagtggggccagttcctagtgatactagcatcaggctggttcttttggccttgtcccctgctacttcccaagccagaaatttagatccaagtttggggctttctcagaaggttcaggtataattcaaggtagaggtattcttccttccagacccctctccccacacagttagtattagggtataattctagtcaccactaacatctattgaacgcttaccaagtgccaggcatcctgtggaatagatgctattatttgcattcccattttatagataagaaaaataagggtcagggaggttacgtaacatacccaaggtcacacagctagaaagtgaccaagctggtatggatgtgtagatctggctgactcgttactgttaggctaatggagcctaacatgaaaataagttactaattatatttttgtattgacgaagaaccatttgccaattttctgcaagccaatttaaagaactggttgaaagagaagcatcctacctatagttctgttccactgtggggtggactgtatcaagaggcttgccagtcacctgcatttgtcaagtaagtcccttcccttctctgagattcagtttctgcctctgtaaatgagagggtcagaccagatggtatctaagaccttttctggcttcatttgctacttcctggtagaatggaaaaattgtagaattggatgaaggacacaatgcattagaaacacaaatgtggagagaatacatagttcatcacggatgggttagttagccagttacacactgtttctgttttcccttgtgaatttataatgaaacattttttttttcttttcagtgagcttcttgctaacatcagaaagtactagctttccttttttgttgtttggttcttttgtttgttggagacagggtcttgttctatcactcaggctagatgcagtggtgtaattacagctcaactgtaacctcgaactcttggactcaagagttcttccacctcagcctctcgagtaactaggaccacaggcacatgccatcgcacctggctgatttttaaattttttgtagagacagggtctcactgtgttgcccaggctggtctcgaacttctagcctcacgtgatcctcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttttgtttgtttgtttttgtttttaatgttgctcagtcatgccacgaaatgggtacctcctaaacactaacttggataccctgctggtttgctgcctttcagttttctattcacataattattgtttgcattcccattctaattttggcctctggtctcagtaagaaggagaattgaaatactcagtgtcacactcattacacccacgaccctcattcatttcacaaactaacctcctgtatttcttctcttcttctggcttggcatagggcttttgacttagatctgagctcaaagctaatttctattactcatgagctgtgtgcctttaggcaagtcacccaatcactgtcattatgtttttcatttgtaaaatggagctaaaaattctatctacctcttcaagttatttagagaattatgtgagttaatatttctaaagctctgggaacactgtgtggtacatattaggtattcaaaaaatattagttacagtcttcctccttgctccccaagaaatagagccagtaacaacaacctttcttctaatacctcatgaacttctcctggcattagctgtctgaaggggctgaggtttgccttttcttttgacgatggagattagtcattagaaactctggatttcatcctcacaggaaacttgaagttgttgacttttgttccttgttaaagagttggtacgactggggcggaaatctccagagaaaagggcgtgttcctctactaattactctgtagacggcagagggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcaccttgatcatgatatattatcttttttattgttcctggatatggtttgctagtattttacatggtattcttaaacactgtgagtgggctgggcgcagtggctcacatgcctgtaatcctagcactttgggaggccaaggcgggtggatcacctgaggtcaggagttcgagaccagcctgaccaatatggtgaaaccccatctctactaaaaatacaaaaattagctgggcgtggtggtgtgtacctgtagtcctagctactcgggaggctgagacaggagaattgcttgaatccgggaggtggagattgcagtgagccgaggtcatgccactgcactccagcctgggcgacagagcaagactccgtctcaaaaaaaataaaaataaaaataaataaataaataaaataaaataaatctgtgagtgaatctggctctagttttcacttttcatactgcctttgtcaggttttcttattaagtttgtgctagcttcataaaatggattggccaatgctgcttcctcttcttctaagctttggaaaagtttgcatgagatcagagtgatttgtttcttaaaggtttgttagaacttgcctataaaactatctgggctttgatattgtctttgtgggaagattatggactactgattcaatttctttaatggttataggaattttcagacattgtatttttctttagtcagtgtctttaatttatgttttgctaggaatttgaccattttgtctaaattttcaaatttattggtttaaaattgttaatagcgtcttaactataaacactacagatatttaaaagatttcttccttttctctcatactattatttgctactaaaaaatcaatctcactagtagtttgtaagttttatttatcttttataggaaataattgagactttgttgatggaactgttacatgtttgttttctattttgttaattgctgcttattttaaaaatctgttttctccttcatattttctttggagttatgtctcttgttcttttcctaacttaggtgggatgcttagcttatttatttttagactttcttatttgactatatgaattaaaaggttaataatttttgctacctactgtttagctacattccactaattttgatataacattttgttattgctcagttccaagtattttggaatttccattgtgctttcttaactcatgggttgtttagaaggattaacagttttttcctaaatgttttaaaagtcatctttttgttgctgatttctaacttaataacattgtgatcagagaatgtgatctgtatgttctgtttctttgaattttgttgagatttgttttgtggcccagtatgatacagtgtccactagatcaaccttgttaattttgctgctcttcaatcaccttaccttattttttctctgcttaatctatcagttactgggagattttttaaagtttaccaccacagaggtagatttgtctatttcttcttttagtactgttaacctttactttatatatttttgaggttgtgttattaggtatagtatgttaatttttgcatttattgttacatctattgatcaaaatgttcaatataggggtcccgtggcaacttagagtgtggatagatctacatgctataagggtggcttggtaatggtgaaagcatccctctgggtgggctgggtaaattggattttcagctccagggaagaaacacccttaaaatcaaaattgcaccttcttgaagagttcttaaatttgacattgccaaacaaaattaacaccctcatatcctcaagtgccagaggcttttgtcgttattgaaaacactcttaaaagctgcattccttctgggatgcatgaggggttgggaaggaaagctttatttttcatgggccttacagacattacttctggttggtcagacatgtttcagacccttggactttcttcttcttactgcctagtattttctatgagacttgagccaaatcctgttacctctctgccttttaggttcaatgactggttcccttttcccctgacagaagtgaggtgtggagaaattgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgccatttaaaagatagtacattcactgggtgcagtggctcacacctgtaatcccagcacttttggaggccgaggcgggcagatcacaggattttgagactagcctgaccaaaatggcgaaaccccatctctactaaaaatacaaaaattagccaggtgtggtggtgggcgcctgtaatcccagatactagggaggctgaggcagtagaattgcttgaacccaggggacggaggttgcagtgagctgagatcgcgccactgcactccagcctgggcgacagagcaagactctgtctcaaaaaaaaaaaaaaagaaaaagaaaaaagaaaaggtagtacattcttttcaaaaggaactattatgatacattgtgtcttataatttttaaaaattttaaaattttttattatactttcagttctgggatacatgtgcagaacgtgtaggtttgttacataggtatacatgtgccatggtggtttgctgcacccatcaaccctttgtctacattaagtatttctcctaatgttatccctcctcttcccctgcaactgccgacaggccccggcatgtgatgttcccttccctgtgcccatatgttctcattgtttgactcccacttatgagtgagaacatgaggtgttcggttttctgttcctatgttaatttgctgagaatgatggtttccagcttcatccatgtccctgtaaaggacattaactgattgttttttatggctgcatagtattccatggtgtatatgtgccacattttctttatccagtctatcattgatgggcatttgggttttaacattttttaaagagttgaggtctcactctatcactcaggcttgagtgcagcagcacgatcagggctcactgcagcctcaaactctggtgctcaagctatctacccacttcagctttccaagtagctgggactacagatgcacaccactatgtccagctaatgttttatatattttttaagagatgggggtctcactatgttgcccaggctggtctcaaactcctggccttaagtgatcctcctgcctcaacctcccaaagtgctagaattacaggcatgagctgcagtgcccttccctagtcctcctttttataataattttaaaaaggtttttttgcttattgttattatttttaattaatccataatattttatatatttttgaagtacagtgtgagattttgatacacgtatccattaaccaatgtctccctaatccctcctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttctaccctcctcggaaacttctagtgctctcagttacttacaaaataaaatccagaattggtgagctgttccttaaggctcttcatgatgtggaaatagacctcttagaaaaaggttgcaaaagcaatgcatactcattatagaaaatttggaaactaaagaatttggcaaactttttctgtaaagggccagatagtaaatgttttaggctttgtgaaccatgctgtgtctgccacaactactcaactctgctattgaagcacaaaagcagctacagataatgccagtatgtgagtgaatgtgtgtggcagtgttctactaaaactatatacaaatcagtcagtgggccacgtttggttcgcgggttattgtttgctgaacactgctatagaaaataaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctcaatcctatctgtattcatgtacctgtctgtggagtcctccctagttcctcctactcgatatgatctcttgcctttgaatccctgtagcactgtgtacctctcttgtggtatttatgtctttctgcccctttttttggttatctctgtactggctttatgcctatggcatggacactgggtaatgttatctttgcattgactcccagagcctagtagagagcttagtgtacaatgggctgattagcctatcagagctatgttgaaaggtgcctaaggtctgctgcagatgacctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaagctgggtatgtatagtgacccacagtaacattgacattgtagttttctggaattttggagaggcagtctagaccctggtagagccgtagagagagagagagagaggggaagccataagtttggttcaaaatggaaactgattccagcgggaggtgtatgttgtgagaaaagggagatgatgccagattggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacaggcgtgagccaccgcgcccggcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcctcccttttgggaaaacatgctccatttaaatcatacgtagtaagtcttcagaaaccctgaccctggaggggctttgggacacaactgacaattaaatctcctggtgtcaggagatcttgcaactgagaactgagtgccccttccacctcactcataattgacaggggccagtgccttgtgtgggcctcacctcacctggcatcaccactcctcacccaaccttacctcaccttaccccaccttaccccaccatacctcacctcaccttctctcctgctcttgagagacaactaggtaactgtgagtagcacttctcccttggcatagtgaagcagcttcctcactgatgctcaattcaaggaaagagaaaagttcttgtcttgagttaccatggggcgggggggaaggggaattttttttaaaaaactactttgagcttcacacttaagatttttacaaaaatcaattatatttggtttctcttttgatcatgaaggtggtatagtttaagggttgaggcatggatactactggaatcagacactagtggactagaattttggttctatcacttgctagctgtttgaacttggggaagtttcttaatttctttgaacctcagtttacttgtctgtaaaatggggataataatgcttgccttgcatggttgttgtaaagattagagagtgtctgtacagcatgattcctgggacccagtaaggactcaataaaaggtagttgttattattaaagcaggtcatttatgtttgtaacaaccacagggttaagctcattgtcccaatatccttttatctcatccctcagcatgcttgcttttgccttcctgaagctgaagatatttatcctcagggcaagagacattgggtgtgagggatttaaggagacagattttcttgacagagggattcttaggtcaagatgagtaaggaaaactcgagagctggatgagtaaggaaaactcgagagcggcctttgccaaggaaatctaaagcaattgccaccctgttggagaggtttctgtcctgtctgaaggtaggaatgggggatagatggatgaatggatgacagccttctgctagccttttgaagagtacattcccaggaaaatagcctctactttctgcagtgtgggagtgagggcgggggatggatattgtttttgagtgaaggaaaccttgtgttccatacttaagcatcatgttcccccaccctgggatgctctgttggcctgatttaaggaaagctttccagttgatcttttaatcttcagaaataacaccagaaatcagttatgccatcactttccttataaaactaactagctttcatttagcagattttgttctagggattcagtgtgtctggatattgaatttttgtactgccggggcaaggttttctgagagtggtatgtttgatgtgtgtggataaggggttgggggtggctcagagggtgagggtgtggagcattgtcttcaaaatccctgagcaaggctgagggtgtttccatgtctactgccctaatgaggattctagcgaataggggcagtgctggctcattcatagatattaaaataaaatgttaagtgggcttccttctaagagtcaactctaaggcattctctccaaatttacttgtctctgttgctatctcttttgttagaatgagaagatactcttgaaaaactgtttatgatacaaatctatatgttaaatcctacttttagtgcagagaggcagcttgcaaaaagtacattccacggagagccttttagacaaactcctttggtaatgtgaattgtagcctttgaatttcttggttgttaaatcttgatttttatgtataggtttgcttcaagcagtttacctattttttacattttagtagaacgactgggtatgttccttttataaaatactcagggaaatggaaccagtgtcatggtctcccttgatctaagttcccagagacttaagacctcagagctgtagcagcaactcagcgagttccatcagcataccggttcccagcagcttttctttatctgtattttaaggagttgtatacagagtcacttttcatgatgacaagatgcagggtaatatgatttgaaaaaagaactgaatgaatcttttttttcccctctgtattttaatggaggcaaactgaatgaattctttccttagtctcttctgctggtctttgccttggttgaaacctccttttccctttgctcagccaccctctggggttacctgctgcttgggctgaagtcctaaggcttagcgacaagtaaccatgtcatgttgcctctgaggctagtgggcacagctgaacactaatatttgggccctaactttcagcttgatttgaagaaatgccactgctaaatgtcatctttttttgtggatccctatttgactgactctttggataaaacaggtgggcaggcaacaaattaagtgggaaatgtttctgtgaaacaaatccgtttaatagtgttacctcataaataagtaacaaacacaactctaccccctaacccgcactagcccatatagccagaatggaaaagtagattgtttctttgtcgcttctgttatggttttacttaaatgaattatcagatcagacccctgtttgtacagaagtttcaaaaatgtttgttgtaaattgatctgagccaatttgattttccacagttaattagattctattctggtaggtatcattaatctccaatagtcagaggtaggtaagtgctataggtttttcccccacaaccagtagattacagtgaaaggaattctgattaaattctgccacgtaactttattaataatcaggcacaagacagttatacagcctgacctgtacacccagagacattccagtactttttttgcaaaccaccatactgtgtgaagggttcaccggagatagatgtgacgatattttagcagtaggactcagcttaccttctaattagagggcacatctgagtcctccattaagtgtctggacataagatttgttgggactcctgagcctaaggtgtcattttaaaggggtgaagaatgttgggctaaccagagtcttatatccaattcatgcaaaagtgggagcaactgaatatttctaaatgatatacctgtcctgaacactagccagtttccctaatgaaatatttctagtatccattgttgtaacgaacaaacgatcagaagtacttcagagctgaggcatgtaagtgtgacttttttccccattagaaaaaagttaaggtatatttaacatacagtaaaattcacccttctaatggtacagttctgtgagttttgacaaatgcatacagttctatgaacactccagtcaagatagagaatatttccaccacccccaaagattccgctgtgccttgattgtgggattttttaagagcagctttactgagatgtaattcatataccataaaattcacctacttaaagtgtgtaattcagtggttttcatatactacatttaaaaaaattagttaaatatatacatataacatacaaaatttgccattttaagcatatttaagtgtacacttcggtagcattaatttcatttgggatgttatgcaaccaccactcctatttctagcacttttttttttttttaaatcacaccaaacagcagctctgtacacattaagcaataacttccaattcttaccttccccaggccctggtaaccactgttctactttctgtctctataaatgtgcctattctaggaacctgttatcggtggaatcatataatatttgtccttttatgtctggcttgttttacttagcaaaatgttttcaaggttgtagcatgtatcagaactttgttccttttttaagggtgagtaatattatattgtatgtatagatcacattttatttatctgtcagtggacatttaggttgtttctaccttttggctattgtgaataatgctgcagtgaatgttagcatacaagtatttgtttgagtccttgttttcagttcttttgggtatgtatatacctaggagtggaattgctgggtcatatggtaattctatgtttagctttttgaggaactgccaaactgttttccacagcaactggccactttacattcccaccagtaatgtacaagggttccaatttctacatatcctcaccagcacttgttattttctatttttaaaattatagccatcctagcagtatgaagtggtatatcattgtggttttgttttgcatttccctgatgactaatgatgttgaagtttatttcatgtgcttattagccatttgtatatcttctttggagaaatgtttgttcaagttctttgcccattttttgaaaaaactgggtttttgttgctgagttgcaggaattcttgattgtaggctttgattagaaatttcagttgctaactaatatcacccctggagtttgtattctcaattaggggtcttcagatgttaacaatggtgtgtggtaaatgtttaaagctctgatttatggcatttgccaatttccatggtcaattccaagctaccagtctgacccctcactaaggtagcaaaggagttgggaagagatgtacacaatcaactctttctagccagtgctattgggcttccagcatgcaacagaatgttaactcaccaccctatggtgtagaataaaactaacacagaggcatatttatcacagtgtctacactgaaactatttaaattaaattagacataactaaataattttcaattacaacactttagctccttcaataaaagcaagaataattatttgttgagcacatcatatgctagatgtgctccaagtattaatagatattattagtaaatagaggaggaaatgtagaataagttagtagtaggctgggacttgaagtcagactccaaagcccatgtgtttgatctctttactgcactgtcttctatcccattagtggaatttacttactgaatgttgactactataaacagagtagactactttcttctaaccccagggatgcttctgtgttactttgtaccctccagcctctctaaatcctgttcaaattggaattgaaaactaaagctgtggtggtaccacatatcaaagaactgtaaggggttaaaaatatccttttcctcgttgcaaaaaaagcatgtgttgtaagaaaaatttaagcaagcgagaaatggcaaaaatagaaagtgaaagtcccccataaacccatctgccagagataatcattattaacaactagcatttattctttcagagctttttctttacacattttttttaaaataacaatgggatgattccttataatctgagtctcttttcacttgataatatagttaggctattttccatgccagtgtgtatagctctactttattcattttaacagctttgcttcattcattttaacagctacataatatcccttgtgtgaaggaaatgtaagggattttgaagggctattttgaagaagtgatgataggtggcacatgggacaaaaaggttgaaaactactgttgggtaccaacaatagaggcactatactttccatttctccccccagaggctactataacttacctgaaaccataagacgaaaatccatgagcactgggaagagttacaggaaaactcaaactaagctagtcagggataattgagagataagactacatatcaaattccttcacatgtctttagggctttacagccctggtctttgaaactctatttggaatctttcttaatctccagtaggccctgctttgagtttgggaaacattgttttccaggaaatacaaccttttaatttcccctcatctgttcctcatcttgagagatggccaccatcatgttttcttgctgtgataatctgtcaggttttttttttgttgttgttgttgtttgtttttgagacaaggtcttgttctgtcacccaggctggagtgcagtggcgtgatcatagctcactgcaaccatgaactcctaggctgaagcaatcctcccaccacagcctcctgagtagcggggactgccaccattccttgctttttttttttttttttttttttttttttactttttttctacagatggggtctcactatattgcccaggctattttggaactcctgggctcacatgatcgtcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaactgactgaacgcttgcagagagatgggctaaaggccagtggtatcagtttatcaggatttgtctgccttacactctcttatccttccctctttaccccagggagctggcagaatggtgtttcctctgtaatatgacatatttagattcttttaccagtttaaagaagttaatttaatgggggtaaagggggctaagtttttagggttggggtcaggtactatcctttataagaaagattatgggtgtttgaagctcatgaatggacatgtcattatctttcaaattacatgctaaggatcaggtttgtatcgtatgtattttactatgccttctggtccatatctcagacaaaccactctgtgccagctgtgctaggtgccagcagccatgaactgtgccagagaccctgcctccctggcttaggttgattggactgagtggccacctgtcaccaagacagcccatctgtcacctagcaggtaacatgggcttgacgagctgagagctgggccttttgtattcctctcttaggaaattagaattgggaagctgagagcctaaggcagtttgtaacggaaaagagccaaaagatgatggggagtggagcagtcatgacagttcatgtcctagctagttttttgaagggacagaaaccatgagcaaacagagggaccttgcaagggaggaacagagatgccttgagagacagaagagctgtttcctacagacaccatgaacccagaaccactttccagttctcctgaggcccagctttatcctaccctaggattcaaatgggatacctgtattctttccacaaacctcccttttcttgagccagcttgaatgagactctgttttcccacaatggaaattatcagaccagatctaggctcctacctttacaatcgacttctgggttgagtcaacaacagttggtttacatttaaggctgacatgaagtgctgaagactattctaggtattacggggaacagtggaaaaacacagatacctgattatttctgtcaagctcagtgctgacgttatgggctttgaatccgtgttcctggcaaacagtgagaatgaaaagaggcagggatcctgactgttcatttatcacttcacagctctcaaccaacagggggccttctttatcctatttaacctctcagtagagtatttgccttttgcttattcctctttccagtcaactcttgattattcatgtaatagaggaaagcattaatgtgaatgatagaagactgccccaccttggcctctcttctctgccacagcagcatccagtcacagaaatggaaacaactagcaggagaggtaaggaggctgaaaaaaggtgggatggggccaagcaaattaacattgtttcttctacttttataccttctttctgttaataaatgctgcctgtttgagtttctcttctggtgtcactaggagattgctggaacagcaatgccatttgcttgatttaagtcaaaatatgggatcttttaaaaaactaaaatagagttgggggcaattgactaggctgttagtttcctctcccatctattgtacccccttttgtcagtgccacccagctttcttgttggctgagtttaatgttgggccactagcaaccattctttgttcaggatttgggactcagctagccaaaatatccacaatagcatttctcaaagtatggttcttgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagcagctgttttggaattagaacttaggccttctgacttccaggcaatggtattttcttccagaggtatacatttctgtaaataaagtctgaatgcattggaataacttaccctgggggttatttgtagcagtctcaaatcatttgatcagggtcactactggtgatatatagagggaaataggagagtgaagtaatgcagaacataccttctgtaatttagatttggatcatttttgctgggcctggagaggaggagctaggggagtacagcttacccatggcgctgcttacggaatttagacataagagatggctgttcattattctgggattccacatctgtacagagtgtagaacataactgaatactcagtaggtatttcttgattatgcgatttgctaaaatcactctgctagtgtgttaaaaataccatttagagttttctataccatttaccatttaattgataagcatgtggtttgataaatgttgttgttattattgttattagaagtagttttatgtagttcttatagagatataagggcctttagatcatttgatttggggccctgcctcagctattaaaaattgcattgtaccttaaatacctgttgcctaatattgtttgccttctcattgtgactcttgggggtttctgctgctcagaatagaatggaatctttcataagactggattaaagggcatacggcctaatgcagcagtctctaacctttttggcaccagggacaggtattgtgaaagataatttttccatggactgaggtggggggtgggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaataataaaggaaattcattgaacaccgttaagaaaagataatgcatgttttccttcaaaccatcaatgctttgccccgtcactgatttgcttgtgcgacccttcttttatgtcactctgaataaactcccctttgtctttctgggccgagggaaccaaatgactatagagggactcttattggagtcacacatttctttcctccttgtgactgccaaaccaccaaactctgggccatttgcatgtgtcttaatttctcctcataatgtggcaaaacacgttttggtgctaggtacgatacaacccttcctggagtgaaccaaatgtggaaagtgctgtaatttgagggagttttcagaaaagagcctcttctggtacagaaaggccctttttccttttttctttctcttttttcatttatgcctcatcatattttgtccactttcagctcatctcaggctgaattttccctttgatgtctgctttatagaatagcccttgcctgagaaaagagaacaaaaggccaactctgtggctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgttatttaaaaattcatacaattttaaaggaatagaatagcatatatgattccctccaacctctgacccctgatccactagttcttctccccagaaacaaactgccattaccagattcttggaaatcctgagaattactgcatgcataaacaaggcttgaatattctaaaatggcttttgcttaggtaaccaagtctatccatattgtatggagacatcttgtttcatttattcattcagcaagtacctgatgagcatctcatatgttccaggcactgtgttaagttctggacctacagtgaggaccatcacacagctcctgctctccagaagcttatggtcagcagggaagatcaacatttaatgaaaacatagctaaatataaatgagaaatggtgatatgtgttgtgaaggaaaagaacagcatttacatgcatctgtttttttttttttttttttttttgagacggagtcttgctctgtcgcataggctggagtgcagtggcgccatcttggctgactgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttcccttctcttccagcttatgtcctgggctgggctctggacagggagcagaggcagatgtgcgcatgtgttctggaggacttttatatgtccgatggtgtgttaggcactatgtggagtggaggcagagggaactccagaaaagataaattatcttatggtggagacaaaaggtagtattggcaacaaacatgacctctggaatcagatagttttgggttccaggcctgactctttgactcacttattagttgtgcgaccttaggcaatttatttaacctttctgtagctcagtttccttgtatgcaaacaggaggaaaataataatctcttacataataggattgctatgaagaatatatgaactaatatgtgtaagacattgactgtagtgccaggcacctagtaagcactcagtaaggaataactactgccattattgttgttactaacaacagtatgagactaataagtgattagtgtataagtaccaacaaataccaatggagttcagaaaaagaatgcttaatttttgtgacttatccaggaaatctctagaggagacagaagaagtggaatgaaatattccaggtggagcaaatatgaaagtgggaggctgaactgaactggagtggggaacaaaaagaagaaacaaacgcaacatctggcacccttgagctctaccaccagctcacctgttgtcactaccaatatgtccagtcctttatggctctccattttggagtgccctgaattactggctgcagttttgacttggccagctagttggccagctgctctgactgagcttgagggtgtctgtgccttggtggagttgacacgggtcctaactctgcaacttggtttgtaggttcaaagcctaatttttatcagcttacccagggctgttggtttctagtggattgggtcacactccccaacattacaaaacacttcttaataaatcaccaggctgataagtcgattgatgatgagagagagacctttatagagatgagaacacttgtgtgtatcagccctttctgatatcaaggtacctgaagccaaattaaacagggactgttttataacctaaaatcagaacctaatggagttgaaaagtctcatgagcgagaccatataggctttggtagtccatggaaaactgtacctttttgcatgtctgtcatagctttgtagtgtgaccagaatgtgtgtcctgttctctctccactgctggagaaacatcagtaacaatttttctcttggatgttcctgttttcaattccatgcaaatgctgtttgtgtgctatggccatgctattctcttgaatttcttttttcttgacaagatttttgagttgcctacttctcagcgacaacatagtgattctctcattgagtgttctttttggctttgttctcaaacactaggaatgtttccaagcagggccgccacgaatggctatgcactgcacaaccctaggagagggtgccattcacatagactataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtggatttgatttgcatttccctgatgactaatgatgttgaacatcttttcatgtgcatgttgagtacccgtgtgttttctttggagagatgtctgttcaaggttatttatctttttattgttgagtttttttaatactttagctatttttaatgtatatatttaaggttttcaacttaatgattatatatatatatggaaatcaccacaatcaagataacacatgcattacatcatagagttatcatttatgtgtgtatgcgtgtgtgtgtgtgttggaaatacttaggatctattcttatagcaaattttaagtatacagtacagtattttcacctatagtcgccatgctgtacattagatatccaggacttacttgtcctggaaaactaaaactttgtactttttgactaacatcttactttcccagcaccagccccagctaaccatcattttatactcagcttctatgagttagactaatttacatttcatatttatgtgacatcataagatatttttctttctggctcatttcacttaacataatgtcctttgggtccttctgtgttactgcaaatgataggatatccttctttttaaaggctggataatataccacattttctttattcatgcatccatcgatgaacatttatcttgtttctatatctttgctattgtgaataacggtgcaaggaatataggagtgcagatatccctttgagatcttgatttcaactgttggataagtattccagaagtgggattgctgtgtcatagaataggtctttttttttttttttttttgaaactatactatttttgataatggctctattgatctccatcagcagttttccagggttctgttttctccacacccttcccaatattgccatcttttgcattttttataatagccattctgacaagggtgacatgagatctcactgtggttttcatttgcatatccccaatgattagtgatgttgagcaccttttcatatacctgttgtccatttgtatgccttctttggaaaaatgtctattcagatcctttgcccattttaaaattgggttatttgtatttctgctattgagtttatgagttctttacatattttaaatattgacatcaaatttgtggtttgcaaatatttgctatatagctttttaggttgatgtagtcctaattgtttttgtttgtttgttttttacttttcttgcacgtgcttttgatgtcatattcaaaaaatcattgccaagaccaatttcaagaagtttttcctatgttttcttctaggagttttatggtttcagatgttacatttaagtcttaagcccattttgagttggtttttgtgtgtggtgtaagataagagtctgatttcattactttgcgtgtggatatccagttaccccaacatcatttgttcaagcaagcatcttttcccccattgtgtatttttgaccctctaaggttctttattccttttcatccttttttttctttttctcttctgatgaggtaattttaaataactgttcttcaaatttgctggttctttcttctgcttgataaatctcctgtttttagttgagtcattgtattcctcagctccagaatttgtttggctgttgtttacagtttctatctttttatttaacttttcattttgatcatacattgttttcctgatttcattgagttgtccatctgttaattttcttttttattgttgagtcttaagagctatttattctgaatactagactcctattagatacatgatttgcagattttttctcccattctttgggtcccctcccctcccctcccctttctttcttttttttttttttgagacagagtctcactctgatgcccaggctggagtgtgcagtggtgtgatctcagctcactgcaacctctgcctccctggttcaagcacttctcctgcctcagcaggagaagtaatcccaagtagctgggattacaggcatgtgatgtgccacaacgcctggctaattttttttttttttaatttttagtagagacagagttttgctgtgtgggccaggctggtctcaaactcctgacctcaagtgatctgcctgcctcggcctcccaaagtgctgggattacaggtgtgagccaccatgctcagtctgggatgtcttttcactttcttaatagtgtcatttgaagcatgaaatattttaattttggtgaagtacagtatatttattttttcttttgttgcttgtgcttttggttacatcttagagtctgttaccaaatcctaggtcatgacatgtatccctatgctttcttttacaagttttatagtttttgctcttacagttaggtctttgattttgagtgaatttttgtatatgggttatgaggtaggggtccaacttaattcttttgcctgtggataaccagttgtcccagcatcatttgttgaagagactgttctttctaccattggatggtcttgataccttagtcaaaaatcacttctgaggatttatttcagtactctcaattctattctgttggtctctgtgtctttccttaggttagtaccacactgtctttgttactgttgctttgccataagttgaaatcaggctgtgtaagtcctcccactttttcttttcaaggttggtttggctgtttggggtcccttgcatttccatatgaattttaaaatcagcgtgtcagtttctacaaaaaaaaatgtcagctgggattctgatacgtactgtgatgaatctgtcatttaaaactttcaaggaggagtgtaacaggatcagaatgctattttaagaataggaacctgacaatactatataaaattagagcaagcttgtccagcctgtggactgcatgtagcccaagacagctttgaatgcagcccaacacaaattcataaattttcttaaaacattatgagatttttttgcaattattttaaaaagatcatcagctatcattagtgttagtgtattttatgtgtagaccgagacaattcttcttccagtgtggctcagggaagccaaaagattggacacccgtgaattagagtgatgaaggaaaaacactggatacttggagatcagataggaaactgctgtagtagtttaagaaaatgatagggaccaaactaggaaaagatagtgagggtggatttcagatgtattgaaaaggttgggctgggtgcagtggctcacactagtaatcttagtgctttgggaggctgaggtgggaggatcacttgaagccaggagcttgagaccaatctgggtaacaaaatgagaccccatatgtacaaaaaataaaaaataaaaatagctaggtgtggtggcacatgcctgtagtcctaactactcaggaggctgaggtgagaggattgcttgagcctaggagtttgaggctgcagtgagccatgatcacaccaatgcactccagactgggtgacaaaccaagaccctgtctgaaaaaaaaaaaaaaaaaagaaaagaaaaagaaaaggtctaagtgacaagacaggatttggggactgaatacatgtggggctgagaaaggtgggggatcaggggtaactctgaggtgtgaagagaggctaatggattagattatagtaccttttaaaactttgtattattttgaaatgacttttgacttacagaagagttgtaaagatattacagagaattcctgtatatccttcacccagcttcccctaatgttaacattttacataactatggtaaaattattaaaactgaaaaattagcatttatacaatgcaatatgaacttaactacagtctttatttgggttttaccagtttttttcacaaatgtcccttttctgttgcaggatctatttaggatccttaattgcatttagatatgatctctctttagtcttctctaatctgtggtagttccttagtctttgcctttcacaaccttgactattttgaagagtactgttcagtttactctgtagaatgcccctgatttgggtttatctgatgttttttcatgattccattgagattatacaatttgggcatccaataaggacgatgctatcaatagctcatacttattttattccctacagtgtgccaggcatttgaactaggtacctcaagcatttaaattttacagttaccctatgaaataatactattgtaatcctcacttgacagataagggaactgagcctaaagggttaagtattctctgtaggcagctggacaagggaagttgagtaatatgtcagaatgttgttattgcaaacatggaattaaaacaagtgaagttagaggaattgaaaatttaatatgatttgttgctgaattggctcatagtagggatgaattttctattgaaatcaggataattatagctattatgtattgagtgctagctatgtgctaggcattgtgccaaatgcttttcttgctttgtttcattttgtcctctcccaaaccttgtgagacatagatactatttttgtctctattttacagatgaaaattcctctaatctcttgcccaaggccagagtgctggtgagtggcagagccaccatgtggatccaagtttgtcttaactctaaagcctgtattctttaaccacttggcaatgctaactgtcctccttccatcttcttagtagggatgaatttgccaatgggactagaaaacatgatatttatgggcttggatgtagacactgcttggttgtggacattaccaaatacatgtttgcaactctccttattttatacctcagtggttggtcaaccccattctttctttgggtatatttcaagcaggttacaatctggtctttcaagtctgggattttaacgcttaactcttagtaggcactcttatttcccttttattcaaattcttgagggaagcttctttataaactccttagactgacaaaaatagtaaaatctcagaaataggcaaatcaagggagataatgaaatcaccagaatgggcgtttaaccgtggagtgtaagggaagctttcctggagaaaatagtttaattttgcatttgaagggtagataagagccacaagaggaaagttggaaaaaccatctggaagagggaataggattagcaaaggcacaatttcttgatgttagagatttaaatttaaaaaataaaattatgaaaatgttaagaaaacaataggtgactctgtaatcccactgttataaaagattttcaaagcgtgatatcaaagacagaagccataaagggaatgacaaatacatctgattacataaagatttaaaaagcttccataaataaaaacctatcataaacagagctgcaacaatgacagcctgggaaaattttttgcaataaatttcagtctatattagctgtcattaatatataaatagctctttacaactcagttgaaaagaacacaccagctgaaaaacagtcaaagtgcacagatggtcacatcccaaaagaagaaatatggctggccaatatacctgttagaaaatagtttaacatttctggtaatctgaggcatgcaaattgtgtgtgtgtgtgtgttttgcctgttaaacacgtgataattaccaaatgataatgacctgtttgtcaggttgcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagaggttcggtagagaaggtgggaacctggaaccagagaggttcgcaggtagaggatgaactgggataacagctgatgcctagattggatgcttaggaaagaactaaaggttagtacagggatctttcctgaggaagctgagagagtgtgtggttttgaatggaaccgtggattttttctgggaaaaccagccaaaaaagacctcagttttataaggattgcaagtgcccaccagacctggggatgaggcaggtgggagctataatgaacctgtctttgggactctgaaactcatctatgtaaatgcaatttgctgtccagttgagtttgtgttttgagatgtctcacactgtagagagtagatcttatgagctggctgatggcacaggtgtggggctgttggggtgactccctgtgtgccatgtggtcaagggccagggctagagtctaaagaaaaggagctctcatgagccctggtatgtgtcaggtgtgaagtggaaagtgcattgaactgggagttaagggacctgggctctcatcagaaagcttgtcagaaccttttcccctcagtttcctcatctctgaaatggggtttaataacatggttctgcctgcctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccacaaaaaaataaaaataaaaataaaaaataaaaaaattagccagatatggtggtgcacacctgtagtcccagctacttgagaggctgaggtaggagaattgcttcagcccaggagttggagggtacagtgagctatgattgcaccactgcactccagcctggataacagagtgagactttctcaaaaaaaaaaaaaaaaaaaaaaaaagataccttctatgctgctatgctgatgatagaaataggcaagacagaaaagatgaaacgactaaagttagaaccatgactgatggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaacaggaaataaagagcccagcagattcttggataattgagaatggtgtaaatggctttctgatttacttaagtcattaaagtgttaggtaggggaaaaaggaccccatttgctgcttcaaatagctccctgaaatagccacttagtctcttgccttaggtgagtaactttcagctgcgtgagggataatggatcctgatttcatgtatttcttacttgaacagctcctaaaggaaaggggtatttaaccctgttttccttccttgattttccaaaatgagctcaattattcagtgtaatgttttaaaagtaacatttattggttctatttcattatgaaagtaacaattctcattatggaaaacacagggacacataaggaagaaacatcatccatcccaaatccaagcaccaagagataattttgcttattacctttcttttcttaagaagcagagatcatattgtatattgaggtgtttactgtatcttttctaaatttaacttggtttattgatacattcatataggtgtgtaaatcataaatatgattgctggatttttttttgtagtggtcctttcttttccctttttttcttcagctcctagttctacctttccacactatccctttgtattaccaaaacagtatgtatcttttcacattttactccatgtgcatagatatacacatgcatacacacatacacacacaagttttggaatgttttgttgttgttcattgtttgttttacagaaatagaatattatatatactttaatatatctttttcattctacaatatctcatagaaatctatcacagtctattgatgtagctcttattcttttataatgttgtaaaatattccatgaatgcacaataagttattcagccattcccctattaatgaacatttactttctttgcacatttctgccactacattcaatgcttaaatcaacatgattttgtatatacccttatatactgttgctttcagtttagatatagatgtaggtagaggtatataggtatatgggaatgtttaaatatatatttatgttaatagatatcgccatattgatttataaaaacaggctgttatgctacactttttgcttttgtatgtaatatgtgagattattattttcttcttatccctatcagcaacaggtgttaatggttcttttgtaattttgacaacctaatggatgcagtttcttggctactagtgagtttcagtattatctcaattttttgtccaattaaatttgttcctcgagttgtctattcatattatctgcacattttcctatgggttgtttatatttttctaatttctaagacctctttgtatattttagattttagccctttgtctatcatcattgttacagatacctttcccaaatatgtttatattgacttttttttttttttttaattatttttttagtagagatggggtttcaccatgttggccaggctggtctcgaactactgacctcaagtcatctgcccgcctcggcctcccaaagtgctgggattacagatgtgagccactgcgcccagcctatactgactttgttgatggaatatatttccatataattgtttgcatttttatatccaaatatgactcttttcttatatagcatctgaatttcaagtcttggttaagatagttttcttgaagataggtagccagttgtattggaataatatattaaatgatccctattttaccctgtgatctctttgcagctattaaatgttttatatgctaggatctacttatggattctctattctgtttcttctttttgtctatttgtgtacccaaatctcatatatttgattacattaggctttaaaaaatatttttctggggccgggcacggtggctcacgcctgtaatcccagcactttgggaggctgaggcgggtggatcacttgaggtcaggagttcgagactagcctggctaacatagtgaaaccgcatctctactaaaaatacaaaaattagccaggcatggtggcacatgcctgtaatcccagctactcaggaagctgaggcaggagaatcacttgaacccaggaggcggatgttgcagtgagccaggactgtgccactgcactgcagcctggggaacagagtgagactctgtctcaaaaaaaacataaaaaaaattcttggctatttgttgtcacttgttcgtacacacaaattttaagatcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttctggttttgaactactcttacattattgaaatacacccgctgatcatagtatattattattttgatacattgctgggttctatttgtcaatattttatttagaatcttgcttcaatattcccgagattagagtcatgtttttcttagtgtttttttcttcaagtttaaggattgaggccaggtgtggtggctcatgcgtataatcccaacactttgggaggctgaggtagaaggattgcttgaggccaggaattcgggaccagcctggacaacataccaggactttgtctctacaaaaaaaaaaaaaaaaaaaaaaattaaaattaaaattagcagggcatggtgttgtgtgcctgtagtcccagctacttgagaggttgaggcaggaggatcacttgagcccaggagttcgaggctgcagtgaactatgattgtgctgctgaactccagcttgggctacagagcaagactccatcttttaaaaaaaacaagtttaaggattaaagttatggtggctatgtaaaatatactgcagaatgttccttctttttctcttgtctggaatactttaactaccgttagaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatccttagggatggttttgcacttactatcctgctactaacttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagtttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacacttgaaaagacatttcccattctaaggttagaatgggatttaaaacaatccagttttaaaatagttttaaaaatatttaacttgtcagtccatcaaaaattcattttgtgactagtatgaagtagagtatagcttatattttcccctagagagtcatttatttgagcaccattcatcaaataactattttcctatgattattgctattatacttttatcatacataaattcttctatatgctaggattttttcagcttgtattattcattgatctctctcttgggttttccatcagtttcatacccttatatatgcaacagctggtaaaccagatttcttttgctttctctgcagcctagcgcattacccacacttttttcttagctagtctcaaccattttttcgtccaaatgaacttagaatgtttctgtcaggttctcctcaaaatcctaccaggattttgattggaactactttaaacctaaaatttcattgacatcatcacaacacagagtctgtcatccaggaaaagacatgatatgttaatttattaattttcttttatgttccttagttgctcacatgcatgtgtgtgtatctcatatatttctcatcaagatcatccctggatagttgatagtttatgatatttattatattttcaaactagttattactggtaggtaggaaaatttttgattttgtgtgtctatgcttaattcttatttctaatagtttttcagttgcttctcttggattatttttgaaattaatcacaccagctcccatatgataactttatttccttttaaagaacaaaactgctgttttgctttcaaacctgattgtattggctagatcttttgggataatgttaaataatagcagtactagcaggagtccttgtcttgcttctgattttaatggaaatgtttctagtgattcacttaatagaaatgtttctaatggttcatattagttggctctgatgttgtctgttggtttaagttagatgttttttataatattagggaattaccttattcttaaattatcaagtcctcacaaaaatcaagaatagttggccaggtgtggtggctcacgcctgtaatcccagcacttcaggaggctgaggcagaaggatcacttgacatcaggagtttgagaccagcttggccaacatggtgaaatcccatctctactaaaaatactatatatatatagtatagtatatatatagtgtatatatatatagtatagtatatatatatagtgtatatatatatagtatagtatatatatatagtatatatatatatagtatagtatatatatatatagagagagagagagagagagagacatggtggtgcatgcctgtaatcccagctactcgagaggctgtgggaggagaatcgcttgaacccaggaggtggaggttgcagtgagccgagattgtgccactgcactcagcctggttgacaaagtcagatctgtctccaaaaataaagaatagttgttgagtttagctgatgttttctaggaatctattaagaggttcatttgtgttttctactttgatctccccatttggtatattatattatagatttcctaatatcaatctttgttagctttctaagataaattttccttttcctttgcatgcttgggagagcctcagatttggcttccatactattaatttgattgattttgctctctgctgtctccaatgtgaaatttatttatttttgttacaatgttaatttctctgtatttctttctagctctgttgagctacttaccctaggttgtctttccttctcaatgttttattctagtggctttctatacctgtttcatagagtccatgttttctttcattctattgaggatgtaaacagttttctaaaatatttcttctggtttatacacaaaattaagacgtttttgtttcctctgagttgtcagagtgatatgcattttccttgtgctgccagaggttttcatatgaactttttttttttttttggtaaagcaacagggtcttgctctgttgcccaggctggagtgcagtggcatgttcatagctcatggaatcctcaaactcctgggctcaagtgttcctctcacctctgactccaaaatagctgggactacaggaaaacaccaccatgcttggctaattaaaaaaaatatatatatatatatattaaaacagggttttgcggtgttgcccagtcttgaactcctggcctcaagtgatactcccaccttggcttcccagtgttaggaataaaggcatgagccaccatgcctggtcaggttttttgtatggtttatgaatattcaaaaaaggatctgtctttcatcaaatacagggtatgtagattgcctttgactatcctcaagctcagattctctctcatattggttagaacccttttcagctccattgttggcaggcaggttgatacacatagcttttaacctgtttcacagtgtctgtcagctactcatctagtgggttctgctggacccatatggaatcgtctacccctactacaatgttctcagatgctctgaaccagataaactatgtgaaacagtacagcctcccacatgtgttactacctgagtgttacttgtgagggctcccactcctagcacacagtgtgccagtaccaattctgccatttctgcccttttgattttggggaattagagtctccatgtgaatgtagaccagttttgagaattgctgatttcctctgcaagtagtaaccacgtagtccaaatggatgtccggtttgccagtttctagatgaactcttggcttctaagccatgaggctgacagttgtggaaggactcaatgtttcctatcttcttttaggtttctgtgggctgctgcatgaattggccagattgttttttctcatttcagtattaggcttattgttaatggagatttctcccagatcctggtaataagttggccatcagtttaagttttcagtgtttggggaattttatctttttctatatcttgataggtatttgagtgggaaattgagagaggctatgttagtgattgctagccaagtgctattttaaagtagaaatccagtgtatattttagattagagcagagattggcaaccatttcctgtaaagggccagagagtaaatattttagactttgcaagccatatgatctctgtgttttaactatttaactgttgttggagcatgaaagcatcacagaaaaatgcaaacaaattagtgtggttgtgttcaaataaaactttatttacataaacaggaggaccagatgaaaaagttctggagatagctggcagtcatggttacacaacagtgtgaatgtacttaatggcactgaactgtacacttaaaagcagttaagttggaaaaaattttatatatatatgtatatatgtgtatatatgtatatatgtgtatatatgtatatatgtgtatatatatgtatatatatatgtgtgtgtgtatatatgtgtgtgtgtgtgtatatatataaaatcatgccaataaagaagccaaaacagaaaaaccatattttgctgactctgagtttagaggaattagatctagcataggcagagagagagaggaagaaattacatatgtacagtaggacagtgactctgttaataagctagaaggcagtgggagacatttgagtatttaagaggaataccataatggggatggtgagatcttggaaagctacaattcatcctagtgatgtcatcttatgatctttacagatggagatacacaagagttcacattcacattctttgacataaggatcagagtagggcttttctacttctctagaggcttgagaaacctctgcagctgtcagaagtgttcatatcagaaacaaaagctaaccagtcatttctttttgcttgtagtacaaatggtgactagtgatgcttctggtagttgatctgagctcttcccaggactagaagatcctagcattttagttattaaccacagcacacttactcaataaaagagcagtcatcagtctgagtcaactgtttatacagcctccagcctaagattcttccttatcagctagagacctgggcttaagaatttcacaatgggctgggagcctcttagagaaactagccttttgagactttctctgagttgggctctcttgtttgttgttgttgtttttgaaactgtctcactctgttgcccaggctggagtgcagtggcgtgatcatggctcactgtagcctcgacctctgagttgggatatcttgaaggaatacatgaaggaaaagggaacagagattaaggttttccaggctttgggttgtaatcagacagtttagctgtattctgaacacccagcacttaatgtgcttggttatccatgtgtatgtatcaagggtgggggaactcatggagtgagtcactgagtggtatggtttaaatggcaggaaactcttccctcaccccgccttgggtaagaaaagggcatagcagagcgctgacacacatccctctgctccagaaagtgtacagtacccctctgctccccactgaaaccctaaagttgttcatcttcatgtgtgccaggaaaggagtggatctgtgatgcaaataggattatttggtcatatctgctgactcagtctaaagaagcttttgaaggggatgagatgaaatttcatctatgctgcagagagcaggaggtgcattgctggatggagagaggactgtaggctgcatgtgagccaaggtagacgagggaagcatgggggtgggcatgaggaactggggcagcctgacacgtgatcttggcattgcaaaactgatatcctgttggcctttgggccacatgatatgatgacagtgcagtatccccatggccctttctttttctagatttcatttatgatactctcagatttttaaatagcatgactttccccagggagaaattcagacctcaggtctctaggactgctctgaggtcatgagatagactcagtttgaacctgttgagtttaaatgtcttggaatgattttagcatctcagtaccccctttcccagtgctcatctggtcagctgctctggaacctgagggattctaaactgagacttagtttggggtcatatgcagttaaaaagggacagtcttttggcaccttcacctcggaggtggctgctttttggcttagcgttggactcatcactgaaaaagatagttgagaggttgtttttgacctgagcagccttattaagactcagttattggcaaaggagagaaggctctgcttataaatgttgcagatttaaaggggaaagaggaaaccacagtaagtaaagagcgattcagggagaccagtttctcttttttattcagaatgctgctcaggtatctgctttcctaggagccaccttattgtcaggttctgccttcggtttatgtgtattcttcccttaattcttagaagagggaagatgctttggggttgttcacaggttcccattcgacataaaatagaagctgcctacctttacatatactcagttttatcttctccaagtctcccagaagttctctttgaaagttcctagagcagggactgcttttattttttttccttctcctaggctttaagcatgtatttagatgtatgtcaccattgggtaaaagaaaggctaaagattcagataacttttcccatctgtggaaacatggaaagcagtactcagcagaggaatgaggactgattattttgggcctctttttactttatccaagtgaagaatctactgtgctatatatttgtcaaaagcaattccaaagggcaggggttgggggaaagcagtacggcataataagatttgggcaagttagataggagctgtgcagttggtaatgaagaagcagaactgtttctttctcattataaaagtaatccatgctaattgtaaggaaaagaaataaaatattatagaaagcaataaagaatacaataataataactgataattcctgttaatatgttggtataatttcttcttagttttctgtaggtatagatttcggctcactgcaacctctgccacccaggttcaagcgattctcctgcctcagcttcccgagtagctgagattacaggcactgccaccacacccggctaatttttgtatttttagtagagacagggtttcaccatattggtcaggctggtcttgaactcctgacctcatgatccacccacctcagcctcccaaagtgctgggattacaggcgtgagccaccatttttagaaacaaaataaagatcattctacatatgatactttgtaatatttaaaatataacgggattgtttacccatctaattaagtattcttaacatgatttctgatggctacatagtattccattgtttggatgaacataatataatgtatttaaacactgttctgttcaattcagcatttgatttatcgggtagacatgttttgaagggatcttgaatagtacagtggaattagagttatagttgcggttctgcttaattcttagctctgtgatcctgagcatagattaaagtcttagcttccatttcctcatttgtaaaagaatgctattaatagtaatgaccctcctgagtaaaaatggttagatgacatgacccatgtaaatttcttagcatgaaatctaacatataccaggaactcaataattgttagtagtagcgtatagcattatccttgtcttgacactttgtcatctgtgtactcactgttagaatttgggtctcaaggaaagaaaattgctttcatttagataagtaaaatttcagaatgaaaattgcctttagataggtagcctcttttaccagttgagtaccttccagataggggcatttgccaacttcctgaatttcacagggaaaaaaaaaattctgcagtctctgtggttgtgcggccccatttggttcagaacaaggaagtgggaaaccaccagctgcaaccagggaattatctttgtgtccgcaggcaaagccagccaagcccccctgttctacttatctttttttttttctttacttgcttgttttttatgttcttttagtctgaatttttttttttttgagcagagtcttgctctgttgcccaggctagagtgtagtggcacaatctcggctcactgcaacctctacctcctgggttccagcgattctcctacctcggcctcctgagtagctgggacttcaggcacatgccaccacactcggctaattttttgtatttatttatttttttagtagaggtggggtttcaccatattaaccaggatggtcttgatctcctgactttgtgatccgcctgtctcagcctctcaaaatgctgggattacaggcgtgagccactgcacctggcctggaaatttttaaacatacggaaaagtgaatagcgcagtacatagaatacttgtatagcttctgcttagtctcagcagttgtcctactttctttatttttattttttattatactttaagttctagggtacatgtgcacaacatgcaggtttgttacatatgtatacatgtgccatgttggtgtgctgcacccattaacttgtcatttacattaggtatatctcctaatgctatccctcccccagccccccaccccatgacaggcccggcgtgtgatgttccccttcctgtgtccaagtgttctcattgttcaattcccacctatgaatgagaacatgcagtatttggttttctgtccttgcgatagtttgtggagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatacacccagtaatgggatgactggctcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcactgtggttttgatttgcatttctctgatggccagggatgatgagcattttttcatgtgtcttttggctacataaatgtcttcttttgggaagtgtctgttcatatcctttgcccactttttgatggggctgtttgattttttcttgtaaatttgtttaagttctttgtagattctgcatattagccctttgtcagatgggtagattgtaaaaattttctcccattgtgtaggttgcctgttcattctgatgttggtttcttttgctgtgcagaaactctttagtttaattagatcccatttgtcaattttgtcttttgttgccattgcttttggtgtttcagtcatgaagtctttgcccatgcctatgtcctgaatgctattgcctaggttttcttctagggtttttatggtttcaggtctaacatttaagtctttaatccatcttgaattaatttttgcataaggtgtaaggaagggatccaatttcagctttctacatatggttagccagttttcccagcaccatttattaaataggtaatcctttccccatttcttgtttttgtcaggtttgtcagagatcagatggttgtagatgtgtggtgctatttctgagggctctgttctgttccattggtccatatctctgttttggtaccagtaccatgctgttttggttactgcagccttgtagtatagtttgaagtcagatagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatatcgatacttcctatccatgagcatggaatgttcttccatttgtttgtatcctcttttatttcattgagcagtggtttgtagttctccttgaagaggtccttcacatcccttgtaaggtggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctgatagtttgtatttctgtggaatctgtggtgatatcccctttatcattttttattgtgtatatttgattcttctctcttttcttctttattaggcttgatagtggtctatcaattttgttgatcttttcagaaaaccagctcctggattcattgatttttttgaagggtgttttgtgtctgtatctccttcagttctcctctgatcttagttatttcttgccttccgctagcttttgaatgtgtttgctcttgcttctctagttcttttaactgtgattttaggtgtcaattttagatctttcctgctttctcttgtgggcatttagtgctataaattttcctctatactcagctttaaatgtgtcccagagattctggtatgttatgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgttcagaagaatgtatattctgttgatttggggtggagagttctgtagatgtctattaagtccacttggtgcagagctgagtttaattcctggatatccttaactttctgtctcattgatctgtctaatgttgacagtggggagttaaagtctcctattattattgtgtgggagtctaagtctctttgtaggtctctaaggacttgctttatgaatctgggtgctcctgtagtgggtgcatatatatttagaatggttagctcttcttgttgaattgatcccttttccattacttaatggccttctttgtctcttgatctttgttggtttaaagtctgttttatcagagagtaggattgcaacccctgcttttgttttctatttgcttggtagatcttcctccatccctttattttgatcctgtgtctgtctctgcacatgagatgggtctcctgaatacagcacactgatgggtcttgactctttatccaatttgccagtctgtgtcttttaattggagcatttggcccatttacatttaaggtcaatatggttatgtgtgaatttgatcctgtcattatgatgttagctggttattttgcttattagttgatgcagtttcttcctagcatcaaaggtctttacaatttggtatgtttttgcagtggctggtaccggttgtttctttccatgtttagtgtttctttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccattctcttctggcttgtagagtttctgccgcaagatctgctgttagtctgattggcttccctttgtgggtaacccgacctttctctctggctgcccttaacattttttccttcatttcaactttggtgaatctgacaattatgtgtcttggatttgctcttcttgaggagtatctttgcggtgttctctgtatttcctgaatttgaatgttggcctgccttgctaggttggggaagttctcctggataatatgctgcagagtgttttccaacttggctccattctccccatcactttcaggtacaccaatcagacgtagatttggtcttttcacatagtcccatatttcttggaggctttgttcgtttctttttattcttttttctctaaacttctcttctcattgcatttcattcatttggtctttaatcactgataccctttcttccacttgattgaatcagctactgaagcttgtgcatgtgtcacctagttctcatgtcatggttttcagctccatcaggttatttaaggtcttctctacactgtttattctagttagccattcgtctaatcttttttcaaggtttttagcttctttgcgatgggttcgaacatcctctttagcttggagaagtttgttattaccgatcgtctgaagccttctgctctaaacttatcaaagtcattctccatccagctttgttccattgctagcgaggagctatgttcctttggaggagaagaggcgctctgatgtttggaattttcagcttttctgctctggtttctccccatctttgtggttttatctacctttggtctttgatgatgatgacgtacagatggggttttggtgttgatgtcctttctgtttgtcagttttccttctaacagtcaggaccctcagctgcaggtctgttggagtttgctggacgtccactccagaacccgtttgcctgggtatcaccagcggaggctgcagaacagcaaatattgcagaacagcagatgttcctgcctgatccttcctctggaagcttcctctcagaggggcacccggccgaatgaggtgtcagttggcccctactgagaggtgccacccagttaggctactcgggggtcagggacccacttgaggaggcagtctgtccgttctcagatctcaaactccatgctgggagaaccactactctctttaaagctgtcagacagggacgtttaagtctgcagaagtttctgctgccttttgttcagctatgccctgtccccagaggtggagtctacagaggcaggcaggcctccttcagctgcagtgggctccacccagttcgagcttcctgcctgctttatttacctactcaagccttagcaatggcagatgccccttccccagccttgctgccgccttgcagttctatctcagactgctttgctagcagtgagcaaggctctgtgggcatgggaccctccgaggccaggtgcgagatataatctcctggtgcgccgtttgctaagaccattggaaaagcgcagtattagggtgggagtgtcccaattttccatgtactgtctgtcacggcttcccttggctaggaaagggaattccccgaccccttgttcttcccgggtgaggtgatgccctgccctgcttcggctcatgcttcatgggctgcacccactgtccaacaatccccagtgagatgaacctggtacctcagttggaaatgcagaaatcagtggtcttctgcgttactcatgctgggagctgtagatgggagctgttcctattcagccatcttggacgggcaagtgtcctactttcttatatgtgaattctgaaacgcaaggtcctaactgcactccctgccacaagacagacaggattgcgctacagcacctcacaaagtgggaaaaaaatgtatacactcttagatccaggggtttatagaaacagaaagtcagtgcagaaggactctggactccgggatggtagaaatagattttattttttcagatggagtctcactttgtgcccaggctggagagcagtggcatgatcttggctcacttcagcctccgcctcctgagtagctgggattacagacgcatgccaccatgaccagctaatttttgtatttttagtagagatgggatttcatcatgttggccaggctggtctcgaactcctgacctcaaatgatctgcctgccttggcctcccaaagtgctgagattacaggcatgagccactatgcccagccagatcttttgtttttataatacaaatcacagaaagtaaatcttagtgtctggctgaaggaaagaagtagatccagatgtccatcaacatgacaatgggtaactaccttgtggtatattcataaaagtgaataatattcagcagtgaaaaacagatgaagtagagctacatgtataaacatggataattagaagttaagtgaaaaatgtaatttgcctaataatctttctctatacaatgtaccatttatttaagggtataaacatgaaacaacactatatgtgatttgtagatacatacaaacataataaatgtataaaaacgtgggcaacaaggaagtcaactactttagagtagaggttccccttgtagatggttgggtgagatgaatcgtattcaggaagggtacatagaggacaactgaatcaataatattcaaatttattaaagctgtatggtaggtgcagaggtgctaatttttaaaatattttactgtatgtttaaaactttaagtgtaaagaaaaaactagggcagaaaaacgttgtttaaaatgctcagaatcctggatcacttattttgtgagtgtgaaagctgagactgggagagttcagtgttttgcttctcatatacatttttgaattttgttcaattatcatacagccaaattggcttttttgggaataaagttctatgaatcttaagacatgtatagattattataattactaccacagacagggtttagaactgctccatcacttctaaaaacttctcatactcttcctttagtgtgacacccagatttctaaaccctggcaaccactgaccagctctgcaatcactgtagttttgtcctttggagaatgtcatacaaatggaaccttacagtgtgtaacctttagagagtgggtttgtttacttagcataatgcctttgagattcatctgagttgatacatgtatcaattgtttattcctttttatttctgagtggttttccatggtctgtaggtaccacagtttgtttatccattcagccattgaagggtacctggactgcttccagattttgtctattatgaatagagttgctgtaaacattggtgtagagggttccatgtaaacataagttttcatcttagtagggagccaggagcagaattattgagttgtagggtgagtactagtgtttttaacttatgaaagttttttctttttctttttttattaaaaaaaacctttataagataccatcaaatagttttccaaatcagtgcttttacatttacattcctaccaacagtgtatgaaaattccggtttctgcacattgctattgtcttttttgttgttgttgttattatagcaattcagatgagaagtggcatcttattatcgttttagtttgcatttctctaatggtagggaacatttttatctgcttatttgccgtgaaaacaacaacatattcaataacaacttcttttggtgaagtgtctgttcacagttttttcagccctttttttttcttctttttttttttttgagagggagtctcactctgccacccaggcgtgatcttggctcactgcaggctccgcctcctgggttcacgccattctgctgtctcagcctttcacgtagctgggactacaaggcacccgccaccacacccggctaatttttttttttttttttttttgtatttttagtagagacggggtttcatcatgttagccaggatggtctcgatctcctgaccttgtgatctgcccaccttggcctcccaaagtgctgggattacaggcgtgagccaccgctcctggctgagttgtgtgttttcttattgttgaatttcaggattctttatatattctggataaaagttctttgttggatatgtgatttgcaaatattttatcccatgttatatgttatatagcttatcttttcattgtcttaaagtgtctttcacagatcaaaagtttttcattttgattaatgtcagtttatcattttttttttcttttatgtattgtgtttttggtgtcatgtctaagaactgtttgcttaactgaagatcacagattttttcatatatttccttctaagacttatagttttatattttctatttagatttatgacttagcttttatataagttgtgaggtttaggttaagtttgttattttacatatgaatgtccaattgcttcaaccgcatttacactattttcaaaaatcaaatgattatatttgtgtgggtcaaattctggactattatgtttcattgattgatgtgtctattcttgggcaatactgcattgtttcggttgctttaactttgtagtaagccttaaaatcaggcaatgtgactccttcattatctgcttcttttacagaattattttagctattcctgtttctttgaccttccatatacactttagagtcagtctatctataaaatatcctgttgggattttgatcagaattgctttgactctatagatcgttttggtgagaaatgacatctttcctatgttgagcctttcagtccttggacaaggtatgtctttccatttatttaggtcttttattttatcagcattttgccattctcagcatatggatcctttaaatattttgttagatttatacttaagcatttcagttttttgaaacattttaagtggttctttcaaaaatgttgcttttcaattgtacactgctactgtgtagaagtgattgatttttgtgtgttgacttcgcatcctgtgacctttaaaaactaatgtattttttaggagcttttttgtagattccttgggattttccatacatataatcacgtccattgcaaataaggacagttttacttcttccttttcgatctctattatttttgttgcctgatttcctcgctaaagttgccagtctaatagtagtggtgagagtggacatccttgtcctgtttctaatgttgtcggggggagcatttagtctttcaccattaagtattagattaggcatagtaattttaggtgccctttatcaggctgaggaagttccctacatcaggttgaggaagttccctactattcctagtttgatgataatttttatcatgaatagatactgaattttgacaaaataccctttctgtatcagttgatatgatcacgtactttttagtcttttttagtcttttcagcactgatttggtgaattatattaattgaatttcaaatattgaactaaccttgtgttaccaggagaaaacgcacttggtcatagagtattattctttcttgtttttgagatggagtctcgctctgttgcccaggctggagtgcagtggcacaatctcggctcactgcaagctctgcctcctgggttcacaccattcccctgcctcagcctccggagtagctgggactacaggcgcccaccacctcgcctggctaatttttgtattttttttttatttttatttttttagtagagacggggtttcaccttgttagccaggatggtctcgatctcctgacctcgtgatccgcccacctcagcctcccaaagtgttgggattacaggtgtgagccaccgtgcctggccaagtattattctttctatactgctactttagatttgctaatattttactgaggatttttgtgtctgttgttcatgaggaatattggtctgtctgtccttccttccttccttccttttcttcctgcttccttcttcttccctcatcttcttctttttcctctattttcttcttctcttcctctccttcctccccactacccaactcctctagttttggtatctgggtaatgtagtgatggaccattctgtttaattgattgatgtgttcattctttcccctcttcaactcaacatgagaaatgtttccttctcttttattttctgaacaagattgtataaatatttggtagaattggtcactgaaactgagtctggagatttcttattcagatgattttaactatgaattcaatttatttaatagtattattcaggttgtctttttcatcttgggtgagttttggagtttgtggtttttgaagaatatgtccatttcatctaagtggtcaaatttatgtgcatagagttggttggagtattcttttataattttaattgctagggttctaatatcttctttcattgctgatattgttaacttttttccttctctctttttatccatgtcattctacctagaagtttataaattgtattgacttttttcaaagacaaacttttggttttattgatttttttttttttttttgagacagtgtctcactctgtcgcccaagctgaagtgcagtggcatgctcatggctcactgcagcctcgacctcctgggctcaagtgattctcccacctcagccttccaagtagctgggactacatgtttgcaccactacatccagctaattttttaaattttttttgtagagacaaggtttcaccatgttgcccgggctggtcttgaactcctgggctcaggtgatctccccgccttggcctcccaaagtgctgggattacaggcgcgaggcactgagccctgcctctctattgtttttcttttccatttcattgatctctgctctttattatttcattttttctgcttgccttgggtttattttgctcttattttttttattcttaaggtggaagcttagattgctaatttgagaccattctttttgcctaatataagaatttccagctgggtgcagtggctcatgcctgtaatcctagcactttgggaggccgaggtgggtggattgcttgaggccaggagatcaagaccagcctggccaacatggtgaaaccccgtctctacaaaaaatacaaaaaaaaaaaaaaccaacacaccaaaaactgggcatagtggcaggcacctataatctcctacttgggaggctgaggcaggagaatcacttgaacctgggaggcggacgttgtagtgagcccacatccggccactgcactcccgtcctccagcctgggtgacagagtgagactgtgttaaaaaaatttttttcctgttactagcatatttttgttgttgttgttcagttcaaaatattttataatttcctttgagaattcctatctatgaatttgcctttccagccatccagagaatttgtcatctgttccatatctttttgttcttggttgttatcaagtactaaattaaaatagaattcatctcgtgaaggatcataatagcttcatttgttatgaataatgtgatattcatttacattgatctgttaaggataatacagccactgtatattgagtgcttattatattctaggcactacattgatcactttacatggtcttattttattaaattctctaaccctttcagtaggtactcttattagttcaattaacaattgtgaggcaattgacacatattttaagtgatttgtctgtagtcacttggccagtaaatggtagggatgggatggaatgtagacttgattccaaacccccttaaccattttactacatttcctctagttatttcacttcttgccttctcataaaaattgttagctttttgagggcagatactgtgtcctacttatacttatcttcttttccctacaatacctgcaacaatgttaggcacacagtaatggattgactaatgtttgtggaactaaattcaacaaaattaactgatctagaagagaatcaaaaccatggtgcttgccatattgcctcagattcttaccagctaagcagactcagtgtagcatcctatacaaaaccaaaaaagcttataggaaatatttgtgtcagtaataatggctatcttgtgttcttttgtgatgatcagtcagatgtggccacaagagtagacagaggagagggtaaggaaaaaacaaagtttattatattcactggtcccagagacaagaggctcaggatactaggcaaggccacttgggaaagacattagggtggtcaggaggcaggagataggagcaaggaggaagttttagtccactgcctttattggggtttccacagaaaaagcagggcagggcaggacagggtgaatagttaaggattggctagtttgaatagtttcagcaggcctctaagctgtagggctgcaccctagttgtctggtgtctggccctggggcaattaaggaagaggaatatagcctcctggggtataaggggcagatagaggaggtctggctttggattggttagtttgcatatcaaaggcatgtttctgggtgagtacttgctgtctctaagaattggctggaggatgggggtcggggtgggggcaggctgtctctagccagaaaggtttttaaagataccaaaatatcacaatatacagaaaataaaatatatgctgcatatcaagcaattcaactttttcttgtaatatcatgacttttctttgcttcttgggagcacttccagcatgactggtggcacttcatctggatcccctggtgttattcaggggttacagtatcacactaaacaggatggaaaacatgagggaagggtcgacccttgaacaacatgggtttgagctatgcaggtccacttagaagcagattttttcaataaatatattggaaaaaggtttgggggtttttgacaatttgaaaaaatttgcaggcaagtcttatagcctagaagtattgaaaaagattaagaaaaggttaagtatgtcatgaatgaataaatacatgtagacactagtgtattttatagtttactactctaaaatatacacaatctattacaaaaagttaaaatttatcaaagcttatgtacacaaacacttatagactgtacattgtgccatcgtaattgagagatgtaaagatataaagatgcactattaaaacataactgcataaaattagctgtagtacatactgtactcctgtaataattttatagctgcctcttgcagtgagctcaggtgttgtgagtatcccttagaatgccctgtgcccctgatcatctccgaatgggctgttctttctccagtaaatggttgatcccaataaaaaagtgatccttgtggttctcgcatttttcatggtgtttagtgcaataccataaatgttgaataacaccagaggacccatacaaagtgcactagtcatgctgaagtgctcccaagaatcagagaaaagttaagacattacaaggaaaagttgaattgcttgatatgcaccatagattgaggactgcagctgcagttacccactattttagacgacgattcatcttgtgaacagatgatgcaaacttatggtattgataaatgtagtacagtactctaaatgtattttctcttcctcatgactttcttaatattttctcttctctgtaagaatacaatatataatacatataacatacaaaatttgtgttaattgatctcagtaaggcttctggtcaacagtaagctattggtagttaactttagaggagttaaaagttataggcagattttagactgctcagggagtcagtgcccctaacctccacattgttcaaagatcagctgtatatacaatacaaagaccaatactctgagctggtaaggaggtttataagtatgactaaccaaatataagtctgccccaagctctgctttttggttctggccttcagtctgtccatctgctttctctggacctccttctcatactttgaattttttaagtagtttgtccctcatatgattttttttctattcctttttcccttcctgtccttccttcactcctttccctcccacctccctccctcccttcctctctcccttccttccttccttccatccaaccatccatccatccatccatccatccatccatccatccatccatctatccatcttgaggctttaggtgagttcttcaccatttatttaacaaatgttttatatgagtcttactatatgccatgcacattttaatgcattttttaaatataattcccataacaatcctatgaattgggtactattatggttcctattgtacagatgagggaactccctcacaggactttctagtggccctatagccatttgccacacccattacaaatttttgtggcaggctggaggggggtataaagttaaaacaaaggcctctgcttctgagttggtcagtcatttacctgtagagctgtgctttgtcggtaaagggcaatgtagttgtgtgatcaggatagttgccacagaacacacaaggggtttaggcatgaccttccttgccccattggcacgcaagaactttttccttcctggcctgcagtctgatacatacacacatagaaacacagacacacacacacacacacacacacacacacacacacacacagacacacacacagagagagagagagagaatgagagagagagagagagagagagagagagagagagagagagagaacatatgtaacattcatgccatggatttaaagcagagtacaatggcaaaaatacaatcttgaaacttggcgacatctgagcgtgacttcagcctctgccacttattgtctgtttgatcttgggcagatcacttaatcacttggagctttggttttctccactatgaaatgaggaagatgatggtggttataataaaaactctgatgactgaatgagatgatatatttgaatccttagcccagtgatttgcacatagaaatgttcaatacatgttagaaatgtttgtgattattaatatgcaaggcttctttatgtattaaagataattcaccctctagcatatatatagcttgtataaactgaattttgagaacccagagcaatgcttgtctttatctagggacttaactgttttggatcttgatgttagttttatcttcatctttggccgtccgtaggtcctgatcagttccatcaacctcaagatttaacttttggtgtccaaatgtctaattggccctgtgcaaatgctgacatttcttttgaggtccatggcaaagcctggcaccagaatccagcttttttttttttttttttgagatgcagtcttgctttgtcactcaggccggagtgcaatggcatgatcttggctcactgcaacctctgcctcccaggttcaagtgattctcctgcctcagcctcctgagtagctgggactacagacgcctgccaccatgcccagctaatttttgtatttttagtagagacggggtttcgccatgttggccaggctggtcttggactcctgacctcaagtgatcctcccgcctcagcctcccaaagtgctgggattacaggtgtgagtcaccacgcccagcccagaatccagctttcatctggactgttgatgtgatttttttttccctctcccagagtgagtctttatgttgtggctgtcacataggagggcccaggggcagggttaagccagattctacttcactgaaggcctggaatggctgttaatagctcctgctatagacagtgaggcttgagccagattttttagtactccatttgtcagacacggggtgccaccttgaatgacactgctgaaaaaggattgtggtaacctggccagccccagggaggttggagtgacattgcgttggtgtgcctcttcccttttatggaccaggccaagccctattaacctgaaggagtgtgatggccttgtttagccaaacagccttttccactttagtcatcctttgaaatcttattaagccaggggcagggaaggaagaaggaggcagacagactcttgaaactaaaaggagggaaagaggaacattctaaccttccacctgaggtcatactttggcaggaggaagggaccagggaattttatacaaggcagcaagagagatataagagtttggggtctggagtcagataaacctggttttgaattctgactctactctcttatgtgtggtgttgaccagatcacctcacttctctgaaactcgtttccttatcaacaaaatgggaaaagtaattgtacctatctcagaagattggtataaaaattaagcaagaaagttcatgtaaagcagttaatcagatacttgcctggaatattattatttttcttctggttcttgattaaggatgcctggaatatattaagtgcataccatcgctattcgcaaagttttggtgacaaagaacaataggaagaaacagcctaggggaagtgaaaagcagtcttggggtttctgtgccattctccggggtctccttgtaacatctttcagtctgtctcccttcccttcttccctttttcccttcttccctcccctcccctcccctcccttcccctccccaagtcttgctctgtcgcccaggctgtagtacagtagcatgatctcggttcactgcaacctccgcctcctgagttcaagcgattcttgtgcctcagcctcccgagtagccgaggttacaggcgcctgccaccatgcctggctaatttttgtatttttagtagagacggggttttgccatattgtctagggtggtcttgaactcccgacctcaggtgatctgccagcctctgcctcccaaagtgctgggattataggcatgagccaccgcacccagccacatctcttagcgttacaaacacatctgtgagtgccaagagaagaggtaaagttctagagagtcttcaacatgtggactgttttcccagccagggcataggaggtatgctgtgtgtgtgtgtgtgtgtgtgtgtgtgtgtgtgtgtgtgtgtgtgtgtgtgtgtgtgattgagattgacatcaacccccatctagtgttgaggtctaagaggcgtgttgcctcggtggtggttgtccatgacccatcaaatcaacgtttcttcaagaggaacagactgtcattcttttcatctctcttagtagtaaagaaccatttgcctttaataatgaaggaagctacttaaatccatccccagagccctcacaagcagggtttgttcctgagttaattgtgcttgacttatgaagggtttctaatgagtatgtattttaacaagtctggcattgggattgggaaacagtatcattaaccagtgctggagaccagtggttttcttcttcttttttctttttgttttgcttttaagtcacagagcccaatatgtaaatgaaagcctggaaggctgcccacttttgctcctgagggcatttctaagaaagtggggaaatatagtttgcaaaacactgcagttggcttcctgggttgtagcaatctttttctgtttaggtctctgtttggggaaaaggattatacatgacagtgtaaataagcagccatgttataataaataggtttctactgtaataacagaacacttacctcccgcagttccccttttctaatgccgcccaagctgtagcagttgaagccgttgattgggactgactgaatgtttagggaacacagagctcattatttaataaagtgttgtaaccaaagtatgttcaggaagtgttcaggggattctgagccagtgatggtgctcttcagaacatttcagttaatacaaaatatgccactattaattcattttgtgcaaactccagtgccattttccacagagagcaacttgtatacatagttctcttccatatgccgtggcttaacctgatgtgtcttttttctccctttgtatcagggtctgagtatgacctgaactttatctttctccccctctaggctacagatgcacatgttgaatggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctcaaaacaataaaaaaataaaataaccagggcagaccaaagcctatacaaactcttggagaggtttaatggaaagaaagcagctttcaggtgttctaaggggctctcgttagattcaaccacattggccttgaataatttgctgtgggagcctcataacctgtccacttctccaaggacttcctagggcaagaattagattccttccccatccacccaaacccatgggccagtctggaccaaacagcccctcatggctagcagggagaatcccatggttgcagcgggctgggtgataaaccagcccagaaagaagcaggagctacgagccatgtcctcagactcccaaatgtgagactgtggaggcattagcaggtcacattgagaagctcagaaaaagaaatcacttataaaattattactactgctttctgacttaaatttgccttaaacattaagatcatagtttaaatctttaattgataatcatttttggatagcattttacagtgtacaaggtttttcgcataacagtgtttgaggtagacagggcaagaattatggcctcttgttttacagaggaagaaaattttactcagggagtaaaattccaagtggcagttaggattggagcctaagcctcttgatcctaagatcacagctatgctttgctccctctccacaaatattcctgtcatctcctccccacaaatattcatgtatacctttatgatagttacaattttcaagatgcatgtcatatatcagtagaaattatagagaaaacattcatctaaagcagcgattttgaaccctagtatgttccaggctcacctaattagcttgatttaatcatttcacaatgcaaacatacatcaaaacatcatactgtacgtaccttataagtacccacaattatttgtcagttaaaaataaaattaaaaacaaacactgatgcgctgccccacccttggagaggatgagttcatgatctgtgataaagcctgagcattgtgttttaaaaagttccccaggtgattctagcatggagtgggagttgagaaccactgatttcatgcaatgattctgaaacgtaatgttcatagcaatcaactgaagggcttgttaaacatgaggcttgtcaggccccatccccagagggtctgattgagagagtctacaagtaatggcagggactgaatgtttgtaacaagtccccaagtgatgccaatgcaggggtccttagaccattcttggagaatcactgtcccaggtgttcgtaactcacagttactccaagtgtgtaactcaaagtgtggtcctaggatcagcatcacatgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacatatctccctgggtctgctgaagtatccttagtccctttatcaataacagtagcggttgctgggtgcagtggctcacacctgtggtcccagctactcaggaggctgaggtgggagtatcacttgaggccaggagtttgagaccaacctgagcaacacagtgagaactcatttctaataaaaaatttaaaaatcagctgagcctggtggctcacacctgtaatcccagcactttgggaggtggaggcaagcagatcatgaggtcaggagattgagggcagcatgatgaaaccccgtgtgtactaaaaatacaaaaattagctgggcgtggtggcatatgcctgtaatcccagctacttgggaggctgaggcaggagaatcacttgaacccaggaggtggagattgcagtgagccgagatcacgccactgcactccagcatggcaacaaagtgagactccgcctccaaataaataaacaaataaatagaaattaactgggcatggtggtgcaagcctgtagtccaggctgcttgagacttccgccctcccttctgaggtgggaggattgctttatcctaggagttcaaggctgtagtgatttatgatcatgccattgcacaccagcctaggcaacagagtgagactccatctctaaaaaaataaaaagtaacagtagcagcactatcagctgctgattcttgagtgcttactatgtgccactgttctaagtgctttacatggcttagatttatttaatcgttgcaataaacttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttggggccctcagtgaatttccatgtgttctactctgccctgtgacttactggcaccaggatttgcaaatcagctagagaatgcctaggcttcagtttctctgggttctccatctttaaagctgaaccctaaaagaaggactgtgtattccagtggcccatattacaagtaagtgctctttacacctaggatcctggaaaaaggtctttttctagattcagatgaattatattaaagggcaatttccagtgatatgcccttttgtttcttggagtgaaggaggggaagtacatgatgaacctattgattattagattagcagggagctcaaagcttgtctgatgtcatcttatcttccagagggtaaatttaggaggataaatgacgagtttcagtagtcaaggtgggtgtccccagaacccatatctcttgactgagacttcagaattatttttctattccatgaatgaaattcagggagagtttgtgtgctggtgatagagtctcttccttgataaatgcacaaacacacaattttgcagacaatttcaggagggacacagactacaacttcctctcctagcccctctcccctctgtaagcccacctattcatcccatgttaatgtcttcctgcctaggctacaaatagttcatagtttagggaatagatgtgctgtctagtgtgtgagttccttgttatagccgctggccatttgtcctgatggtgatactgggttccttatctatacccgtgactttgcaaagaatatcatccaatccaggataaaccactttcaggaaattaaagccaaggagtggaagctaagtagggtgtccatggaacctggttacagattagattttcagttacagtactcacgtgcaaagctagtgatctggccctgaaatgagacactgggcccatgctgcaacttcagcgctctgcttttcaccctctaacccccatgagagtttcttctgaatgcagaatgttgttagcaagggagactggatacagaaaagaaagtgaagatactatatcagccctcttcccagaccaaaaactctagcctggcctgcatttgtgtttgtacccatctgtcttctactaggagaagcatgataattattcttttcatcaagctcctttcttcttcaaggcctaaagcctcaagtacattattatcttattatcaaacttgcccattattatatatccatgttgatctattatgttagttcctttttaccccctttactaccactctccttttgcccagttctttctgctctgttggatgggatggttcttttgagtattcctaactttcagactgagtggaagaagatagtaatgattctgtcattactggggtgtctagcctccattcacaaacactatattgatgttcttgggatgcagcttttccactgacacaccttgtacccatgtgtgctgctggaaaaaccttgttgtcaccaatgcagataggcttgaaaatctcactctttgctaattggcacatcgaaatgtgctagttgacctagaaaagttatttctgtgactggcaaattgggctattttaaaaagttatagtttggattttggacctgaactgaggacagaatgtccctttattatcctgagggttcttaaagcgtacaaagcttggtttcaaaagaggtattaattttctaaagaattgagtgaggcacaatagtgcctcaaccttctgcaaaggccagtatgtttctgatcagatgaatgcattgtgtctgaggatgtggggggtattgagatgagtttgggattcctggtccaaaccaaattctagggactatcctagaatatgtcaacttagtagctttattttaagactaagctttgagggtcttaaatccttgatgaatccagcctagatcacaccagtcaaaccacagatttttattgagcactttcctgtgttaagtatcatgccatgtgctgcagaagatacaaaaacaaccagtgtacattcctggtcctcaaagaacttgcagtttagttagaaagataaagtataaatgcctgaaaagttatggcaatattaaagttgaaaacatgaaaaaggaaaaatcatggttgggcatggtggctcatacctgtaatcccaacattttgggaggtcaaggcaggaggattgcttgagcccaggagtttgagaccagcctgagcaacatataagaccctgtctttacaaaaaataaaaaaatagctgggcgtggtggcacatgtttataatccaagctacttgagactcaaggctgaggtgggaagatggcttgagcccaggaggtcgaggcggtggtgagctatggccaacactactgcacttcagtctgggtgacagagcaagaccctgtcacaaataaaaaagtaaaacttacaaggcattcaggcttgactgctaaattgcagttgctctatgtttcaagaaatgggaaaaagattaatattagcattcactgagcccatactattttccaggtaatttacacatatattattcaattctcataagaaacccattttacatatgaggaaactgaggttcagatcagattaaacgacttgctcagagttacatcatttgtaagtgctaaagctaaacctgtgcactttgtaccttaatacacagcctcctggagtaagtggtctggaaaggcttcatgaagaaataaagcctgagccaagccttgagggatggttagaatgtgcatgcaaattgcataggaaggaggctgttcaagctaagggaacacatggacatggaggcagaaaatagtcaactaagtattgagattctgaagagcagggtgggagtcagggattccagttgtacacagagacattaccacttatttgcaaatcacaagaagacactgtttctgtcatgtctcttaacccttacagtatttagattttgtgtacatttcctatcttttcaacctccacaaataagaatttcttatgtgtggatgggactttggaatcagaatagctcttttacacatatctcaccctagtgtagttgttaaggggattggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacctcagttctctcatctataaaatgggggtgataatagtgcctatttcataaagctattgtgaggattaagttagttgatgtgtgtaaagcaaatagcattgcactgttagccattattagtctttgatcctcaccaaaaccctgtgaagtgtgtattagcatgtccattttacagacagagccttagaaagtttaagtaacttgtacaggggggcacacaggaagtgacagaactagcatgaaaactttggtctttctgataccaaaggtcatcataccaaaggaaggtttggtcttcttctctcctagttatttagattgatttttaagtattcagccatatgaccgccttttggcaaattttatacagtatcgattagcaatttgggggcttaattttacttttaggatttttttgttacagaaatagtagatgctcatgactacagtagcaataatatattgtatatttcaaagtagctagaagagaggacttgaaatgtttctaacacatagaaatgataaatactcaagggcatggataccccaaataccctgacttgatcattgcacattctatgcatgcaaaaaatactcatgtgcactccataaatctgtaaaatattatgtatcaataaaaggaaaaagatttttttaaaaatgagatatgtgaaatatagtgaattatttcagataagttctaggaagaaaaataatacatggtcattgaaaagtaactcagaggactataaagaaaaagctaatcattttaccagcttttagtcctgttgcctcaagggtaaattgtgttaaaagtatctttttacacttatcctttgcttgtacatggagattaaagattttcatatttctaggattgttggtttatttgggttccagcttcttacacacttggaattctacaaataccactccagtatatttctttctcttttttttgaagtctcagtctgccacccaggctggagtgcagtggtgtgattttggctcactgcaacctttgcctctcaggttcaagtgattctcctgcctcagcctcccaagtagctggggtcacaggcatgcgccaccacgcccggctaatttttgtatttttagcagaggcggggtctcaccatgttggccaagctggtcttgaattcctgacctcaaatgatccacctgccttggcctcccaaagtgctgtgattacaggcgtaagccaccatgcctggcccagtatatttctttgtttaacttaaacactagataatcagtaatctcttcaggcatggacataactcttttcatccatagtttggttggactatatattcatatattccttctattctctgtgggtaaggacagtgtcttttttctttcaagtgagcagtttaataggataaaaatattgcggaccactgacctacttcaaacccctcatgttacacaaaaaatagacacagagagatttgttccagggtccactgttagataatggtaagctgaagtacagacttagaattcccgtttgtttacttcaaatccaggactcttttctgctttgccattctcattattcccgagttctgaagaccatagtttccacagagtgcatgtgcaagtggattatcgctggacaccaaattccaaatgttcaagtacacatcatttcagtacacacacatgtggctagtgtcctttccaacctttgccaaagtaccacctcactttatgaggcaaaatgtgtaatggagtcaaagtccgaagaaccaagcagtagattgtagagcatggatagagatcaataataaatacttcaaagttcaaaaatggcgacatttgattcattgtgaattgacttgtagaaagccccattggagctgaggacaagtgtcttttgttttgtggctgcccctacatagccttgtacttagcacctggtagatatctatagatagaataaatgaattcatcagccaacctgaacctctatgttgcttagggaaattctggggatccctctcacatatgtcctgggatcttgggtgcaaagacagaggggtgatagataatatttttttccaggagaatttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacactcatttaaaaattttacatcattttatttttggcacctaataattgcacatattttggaggtacattgtgatatttagatacagacagtgtgcgaagatcaaatcaatcttgttagcatatctgtcacctcaagcatttatcatttctttgtgttgggaacattcaaatcctctcttctagctattggaaaatatacaatacattattgttaactatagccaccctacatggctataggacattataacttattccttcgatctagctataattttgtatctgttaaccaacctccctatctccaccctccccagcctctagtaaccaccattctactttccctttctatgacattaactttgttagctcccacatataagtgagaacatgtggtagttatctttctgcacatactcattttttaaaagcactccaggcaattccaatgtgtgcaaccagggcagctctgctgtacaccttgttctagttctgccctgccactggctggggcttggggctttgaaggatttaatttcaccatattaagtatcagtttccacatttttcaaatgggatttgtaaaatttaccctctctacctttcagacaagttataaagaaaagataccaaaagataacaatgaaaagataacaaagagctttggaaagttaaaagcactacacaaatgagcacttgccttgttctctctttgacttcagtcacaattttttgtaaagggggtttaattgacatataatttacaaatgaaaagtttatccttttcaaatatacaattcagtggtttttaatatattcacagagttgttcaattagcaccacagtctaattttagaacactttcatcaccccgaaaagaaattgcataaacattagcatcatccccattccttctttccttgttctggacccaggaaaccactaatctactttctgtctgtatggatttgcctattctggacatttcatgtaaatgtaaccatataatatggcattttgtgactgacttctttcactcagcagaatgttttcagggttcatccatgttgttgcatgtatcagtacttcattcctttttacggctgaataatattcctttgtattatatatcacattttgtttagccatttgtcggttagtgtacatttgggttggttctaccttttggctattgttaatatgctgctatgaacatttgtataaagctatctgtttgtctgctttggagtatgtacctagaagtagaattgctgggtcaaatgataactcagtgtttaaactttagagtaactgccagactattttccaaagtggctataccattttatatgtccaccagcaatgtatgagcattccaagttctcaacatcctcactaccacttgttattgtgtcttttttattatagccattctagagggtgtgatgtcgtagaggttgagtatccgttatccaaaatgcttagaactcgaagtgtttcagattttggaatgctgcactttgtacttaccagttgagcatccctagtctgaaaatctgaagtgcttgaatgagcattcttttgagcatctctttaatactcaaatttgacccagccatcccgttactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagctttaggagatatacctaatgctaaatgacgagttaatgggtgcagcacaccagcatggcacatgtatacatatgtaacctgcacattgtgcacatgtaccctaaaacttaaagtataataataataaaataaaataaaataaaaaaataaaatatctgataaaaaaagtttcatattcaggaacatttcagatttcggatttttgaatgctatttctctgataactaatgatgttgaacactttttcatgtacttactagctatttgtatgtctttttggagaaatatcttttcagatcctttcccaaattttaattgggttgttttcattgttcagttataattgttctttctggatattaaacccttatctgatatataatttgaagcattttctcccattctgtgggttgtcattgcatttgcttgattgtatcctttgaggcacaaaatattttaattttgataaagtctaatttctctatttttgatttggctgcttgtgcttttggtatcacatctaagaaactgttgtctagtccaagatcatgaagatatatgactgttttcttctaagagtttcatagtgttggctcttacatttaggtctatgatccattttgagttaatctttatgtgtagtgtgaggaaggggtccaaattcatttttttcatgtggatatccagttgtcccagcaccatttgttgaaaagactcttctatccatccccattgaaatatcttggtatcctttctaaaaatcaatgaaaaataaatgtgaaggtttatttttagaccctcagttctatctcatttctctatatgtctatccatatgccagcaccacactgtcttgattgctgtagctttgtagaaagctttgaaactgagtgtgcattgtaacaagatcttctggggattagtgtgtgtgtgtgtgaatgttgaaaagggctggaaagcaaagttgaaagaaagcaaaatgagcaatatagtgttcagatgataaggcccagggggattgactagcctgaggccacatagccagtgattggcagatcttggttcagcactcaggtcttctgacttccacatcagtgctctttccacctcccctgttgcataagtactgaatgagatgcctttggttaatggacactctgagcaagagacttcagggttatttaagcaactgaactttgctcaatcgcctcatctgtacaacagaaatattacctctatcactggctgggcctggtggctcacgcctataactgcaacactttgggaggctcaggaggaaggatcacttgagccgaagtgttgagaccagcctgggcaacaaagtgagaccctgtctgtacaaaaaataaaataattagccagccatggtggcatgtgcctgtagtcccagctagtcagaaggccgatgtgggagggtcacttgagcccaggaatttgagaccagactggccaacatagtgagaccggtctctaccaaaattttttttaaaaaattagccaggcgtggcggtatgtgtctgtagtctcacctacttgggaggctgaggcaggaggatcacttgagcctaacagttcaaggttaccatgagccatgatcatgccatacactccagcgtgggtgacagagtgagaacctgtaataacaaatggaaggaaggaaggaaggaaggaaggaaggaaggaaggaaggaaggaaggaaggaaggcaggaaggcaggcaggcaggcaggcaggcaggaaggcaggaaggcaggctggctggacggaaagagggaagcagggagggagggagaaaggtacatcatagttattatgaggattcaatgaaataatcctttgttgggtgccaactggcaagatgaattcagttttccattgcataaaaagaatcggggggtaggcagagctcctcctgaggcccatctcttacctcaacaggtggcctgccaacctccccttaggtcccacacgcctaggaccttgagtggagtgaactgagactttagggcaaactgagggtttctttagaaagtccaaggaaagagtgatcacttctgggtcccggtactgcatgggtgccagttgaggaagctttggtggtaggatccggccagaggagctaacgcaggaaaggagtttggggtggaaaaacttcgtaagctaggaggtcctatgatgtagtggataagaacaggagtgtatgtatataattttatattgtagaaaattgaaagcatacacaaaagtagaaaaaatgttccctaatgcatctgtcacccagtttcaatgattgtcaccacatagcccatctttttctttttaacaatacacctcactccaccacaaatccattccacccccaacacaaacacctatccctggattatttggaagaaaatctcatgtaattttaactgtaagtatttcattatgcatgtctgaaatgtaaggacacagtaaaaaataaacattacaataccattatcatacctataataactagcaataattccttaaaatcatcaaagatacctagtcagcagagcccaggcttttaatctagccaaatcactgttccagtcttccttctacagcatcaatagcctgtctcagagcctgttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagcatctcctgctctgggacagttacagactgttggctttagcagtgatttggagagtttgtgcttgctttggctgggaaagagacttatccatagcctactgcctttcaggattcttttctaaggggatatcaatgcctgctctccacgtctattttctcgaggcccacagtggagcacaaacaatggaaacataggaatccatgcagagggctttagcgatctcctgggacactgcttctgtcctgtcttttagcccttatagtttatagtttagattttacatgtgtttcctatcttttcaaccttttctaataagaattccttacatgtggatgggacttggcaaccagcaaatctcaccttagtgtagttgttgaggatgggttcagggattttctagaaaataaatctattttctaggtttatttcctggctgggccactcctgtgtgtgtgtgtgtgtgtgtgtgtgtgtgtgtgtgtgtgtgtgtgtgtgtgtggtgttggtgggaagaacataaggttcttcatggagtgggtgttcaatatatgactgattgaagagaaggtcaatttgtaggtcaactaggtggtgctgaaagaattgagcaactcccatttgtgccttatgccacatgcactgtacataactgtgtcttggtctccaaactaggccagaggtcaactgtaacttgggccaaaggtgccttctgtttccagttttgagcaagggaatggcagctctccatatggagcagggaccagggggtgctgttggcagatgcatggtgagagctgtcctgaggaagtaccatccagagtctcgtcctagcaaggtgttttagtgtggttaaagggtcactcctggccgggtgtggtggctcatgcctgtaatcccagcactttgagaggctgaggcgggcagatcacctgaggttggcagttcgagaccagcctgaccaacatggagaaaccccgtctgtactaaaaatacaaaaattagccgagtatggtggctcatgcctgtaatcccagctactcgggaggctgaggcaggagaatctcttgaacctgggaggcggaggttgtggtgagccaagatcgcaccattgcactccagcctgggcaacaagagcaaaactccgtctcaaacaaaacaaaacaaaacaaaacaaaacaaccacaactcaactcctgcttccaaagatggaagtgagagaagattctttttcctttaactgagtgggcccttagttgagatatacagacatgttttaatttcactaactcggccccacagtgtaggagggggaaaggaacagcaagtagtccaggtagaggaagagctagggtccccacactctagccagaattgggggagctccaccttctctgatcaggggagagacaggattcccatcacctccttccaataactaaaataaccacagcacaaatatgtgtcctgtatcagcaagctgccattgaaagagggccatggaccctgcgtatgatagagcatgctaggtgcactcatggtccttataaaagcagccaggtatgcatgggctgggccctgcatgcacaagttacccattggtccactaaacgtatgttcctaaaacccattatggtcttaagaattcagactggcatggatgcaaaaattcagataacccctaagtaataaaagtacttatttttctttagaacctaagacctataagtctcaactaatttgaagaatactctggtgaccaaagggagaatgcctcttcaaaagattgcttttatttggaggttgcaggccttgcatagggtcgttcccccagcccccggggactctgttaatgaaggggtttgggtagggcttgagcctctgctccttcaacatttcagcatacacacaaaagagcctacttctcagcacagatgtgactactatgtgtccacttggatgtcacatttcagggaaggttcattcataatacaggtaaaatgttactatattttatcctctgttgttgctttgaaaagtcagtggtcagcctttttactcctttgaaagtaatcttttcaggtcacttttgaggtttttttgtttctttttgtttggtgttctgcaattttgctatatgtttcagtattgatttgttctttcttattctgtttgggagcctttgggcttctggtgtgtgggtatatatcattcatcaggtttcagaacattctcagctgttataacttcaaactctgcctctgttccattctattcttctgggaccacattttagagatatgttagtccatcttactgtgtcttcttatctcttaatctttctttgatattttctaatttgtcttactgtattgcactttggctaatttcttcagctgtatattccagtttattatttatctctttagttagttctatccattgagtttttatttcagttattatatttttaatttttttcaaacatacaaaacagtctgtaggtaataattttattatctgcagtctttaaatttctgttttcaggattcctggcttgtttccttgtgtatttaagttttctttattttaaatattattatttttgttgctttactgtaagttgcttattttccttgggattttatttatgggtagtttttgactcctggtttcctgtagaaaggatctgtcttcattcttgctaggcacctgagagctgccagtctggaatcatgctaaatgaattctgacctcaggttttttgattacccaagtagtatacattcacttttcaaatacacatgatggctggcttgccgttccaagtttttattggagataacctagttcctttccctgctactccaactcagtgtaaagattgagagtagattttccttatcgtcctagggggcaggagtaatttgtatttctagtacacgtttacactgaagtgtagctttttggggtcccagctttatgagagttatctcctatcagactctttttgggatatcttgacctttgtcccccatcccttatgccctgtgaagctatgagaaatcaaagctcaagttcagctggcttagcaaatctactttgggtgaaaattggatgccgtatcccacttatgtctctgggttcccactttcactttttttctggctagaaaattccttgtgtatttgacagttcatagattgaaaaataaaacaattttaaaaatattttatccaggacttttggatgttttcagtggtagatttgtttaagaactagctttttatatgctcagaaatgaacatctggatcttgttttccaacacttttatggctgtgtccttactttcaggagcaaccaggaggacattctaattctattccttggttgtcagtgctctcctgaaatatctctaaataagttgataaatacctactgtgtgtctagtattgtgctaagttctatgaaatatcgggaagaccatgtagcttctcatgtagctaacagaacattggcagtagtggccttcagcccttggaacactgatttaaaccatattttcatttccaaacccttttaagccctagaaattagcatttagaatgatgtggttgtaagactgtaaggtacataaaggcagaggccatttgtatcttgtttataatagttggcacatagtagatgctcaataaatactgaatgaatgagtatctgggaggtcatggaggcagattccaatgctgatcagttcccatggcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacatgtaggtagtataagtcggtgattaagaacatggactctgaagtcagactgcccattttcatcctggctctgtaagttacgttgggtcagttacttaacctctttgtgtctcagttttcttaggttctacctatagagttgtaggaattagctactacatactaagtattaagacaatgcctggcagagaagtgccatgtactaacaattacttattatttctattattattatctccgttgttgttttgaacaccagtcacatcataaaaaatacattctcctgggagttatttgtcatttctatatgaaaatattctgagttttcatacttaccccttaggattttggagcctgccctactggagtatttctccaggtaggggttgaatacctctgtatctttttttttttttttagggaaatatattaaaatacaggatgctgggccccatcccagttggtccaaagaaatttctttctctgaaactctgtgatgaaaataaagattctacacattctctgtgtgttgggttagccaggaactgctgcaggtttaagtttaccatccttcagtgctgatggaaaatctgggagcaggcttggagcctgagaagaaatagagaattggagagttaaacagaagagaagagaagaaagaaagaaatagaaagaagtgaccagagtgtactcatgtcaggaggtggtcaaatcccatccatctctggtggcctccaggggatatgtgacatttgctttcccttgatttagggatttatgaacctggctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggtagtacctatattatggcagctaggtagcgtaagtccttccgttttcatagtagactttatttcttttccatcagggagcagcctgaagtatggaacagacaataatggttaagatgatgggttcttgagccaggttccctgggttcaaatgccggctgagccacttaataaacccaagaccataggcaaattatttcactgaaaccctatccctttttcttttaaaatggaccttggatacacataattggagtaatcatatttctaatccttgactcatttcatgctgcaccattcgtccatgtatagcctgctttaattttatttatgtgtgcatttacttttttatggataatatgacaactgtgagcccaacttaagaattagccacattgatgagaactcagtctgcctgtgtgctgctcccccaatcctgctctctacctccctctccaccctgaaggaatcgctggcctgaattttggttattattctttttctctttttgaagttttatctctctcatatgcacagagatatttatattcatattgatgtagctatggatatatagatatatacatgtagatatatcttcctaaataagatattacttggttgtttttctggccctcataaaaagggtattatgttttaggtagttttctggtacttgcttgttttactcatcattatattagtatgattcattcctgccacagagtataactgtagttacaatttcactgtggcataacatttcatgttaatataccacaatgtatttctccagtctccttgagatgggtttttggtcatttccagtattttactatcatgaaaaattcctctgttcctcagttttctcatcttcaaattggggaataaccataggagctaccacataagggtgttatgaagataaaaggagttaaagtgcttagaacaagaccttgctcatagcatattgttggtccgtgtattggtttgttagggctgctatgacaaatatcacagactgggtggcttaaaaaacagaaatttatttcctcacagttctggaggctagaattctaaactcaaggttttggcagggttggtttcttctgagggcctctcttttccactggtgagtggctatcttctcccaatgtctttgtagggttttttcctctgtgtctgtctgtgttgtaatctcttcttctttattgtttttttctttttagttggagtcttgctctgtcacccaggctggagtgtaatggcacgatcttagctcacagcaacctccacctcccaggttcaagcaattctcctgcctcagcctcccgagtagctgagattgcaggcacctgccaccacacctggctaatttttgtacttttagtagagacagggtttcaccatattggccagcctagtcttgaactcctgacctcaggtgatccacatgcctcagcctcccaaagtgctgggattacaggcatgagccaccgcgccctggactgtaatctcttcttatgaggacactggtcatattggattaggacccacccatatgacctcattttaccctaattaccttttttaaaggcactatctccaaatacattcacatactgaggtattgagggtgaggaattcaatgcatgaatttggggagagacacaattcaggccataagagtcagtaagtattcattatgaccatcattctcttcaccctcctccttatcattaaagctcaagaaaatgcagcagacttagttatgatatatcccctaggaacactattatgtgaactattattattatccttaggcagaccaaacaccagagcttccttcccggccttttcagaaatgactttggatacttggataccagcaacaagtactcaaaaatggtaaattgtggtttcttaagatgataggcagcagctccttaagtcagttagatgtgggaggaggagagtgaggaggtttcatttccatcttggttaaaagaaacagctaagtgagctcttgtagagtatctaatggtatacagactcgaaattgccacttggtaaagttctatgggttttcctgaaagaggcaggcagatctggtttttcaaaccaggaaatacacttgcacaagtggctgtgccaccagaacaaacagcatcttttatgggctcaaagtatttgacattagggagctggctaggggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaaaaaaaaaaaaaaaaaaaaaaaaaggaccagtggctgcccccccgcttaattatgcccccctgccctttccatgtcagacgatgaaaattagatggaatagcatgtgcctggcagggctgtgggcatctgtccttactggaggtgaggtgaggagtgggagtagggtctcgagggaaaaatacaatgagaacaagggatttgggggtctatggatgccccctttacacattattttcttaacaggctgtgattctccaaaggagggaattcttaaaaactagaacaaattaacactaatcatcattaataatttaatgcatcctcttggataaggattcctgtaatgtagagatgtaaagaatgtaacataaaagttcccacctcctactccccagagagaattgctgttaacagtttggtgtacttatcttttaacttttttcatcctttaaaagaatttagctacatgattaaaaatgaatacattcatttgttataaaaaatatatatatacaagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaaaaaaatcaggatccagtgaagtttcaagtattgcttttgattattccatctctttactggttttcatttttttaacctaagaacggtacccccttcttcatttatgatactgaaatttagggagttattttgtagaatgtcccacattctggatttgaatgtttccttaatgacaccttcttatttttaatggcaatgtggtattctgtaccatgaattcatcgtggtttttttaactagtcccctattgatggtcatttaggtcgtggcattccttttgtggctcctctcacaagtggtatttcgtcctaaggagtttgtggccccagtaggccacagttaaagtctgtggtcagttaatgaagataaagtgttccaaaacctaacttcgctggcaggaacattatcaagggcagttgtaaactgtgaattgcatcctttcccctctaaaggagatggattatcttttttgattccctgatttattttgagaggctgtagtctagggctgagctgagaccagggttctgtctttgtaactacctattctcacttggcacctgatcattaaccatggactcttctggtaaggccaagtcacctgaggtatggtgtgagctcccttaatttgcagtgtgcagccctccctcaagcagttattctcacttcagcctgttcttccttcctcatctcctgggatcccaaagctaatatttccatctgtgctttgggtcctattccctcccacctgcttccagtcctctcgctgtctagtgcctcctgccccttatgcttctccagcatctccctgtccactggctccttccttcagtctatacagaatctctcctgttcttaacagttatttctcaatattgataccaccctttagttatagttttcatctctctccaggcatttactcttctcaaaagattactgaggaccaggggtccaccaaatggggtgcaagagatgttccattgggtgtgtgaagaaaatgttagatttctattctaataaaatttcatccttttaaatttccatgtttgtgtgtcctgatgtacatttaggtgtgcatattttataatttacagttatacatgtatatcatttgccttactttcgattcttatcatcctctctagcccccttcagatccacacccacctacattctcaccgatttatgagcttctctcccaggcagtcacactggcatcacaaattcagcatggccccagcttcttttcttgtacctcacctcctccaatctgcaccctagactgtaggtcccaacatagggagaagccccaacatcccaccatccatctaagccatagcctgtgagtcatcttcaacttcttatcttctcttacttctgcacaataccctgtccagtcaattaattagtcctggcaattcaacttccttaccttctctcaaatctgcccatcctctcttctctcgctgtgtctgcctttgtttaggcattgctatcgccagcccctaactggtccctctgcctcaagtagcaaaccctgcacacaaccaccaaaaggagctctgcaaaactacataccatgcatgcctctcactcacttagaaaattcaaaccaaagccaatacatgatctacagggcctcccatgatcttttcctgcactgatattcttgccttatctgttagcctcctcaactagactatgaactgttgtagggcaggggtccctaccctgcaagatgtcttcattattgccacatagcaagaggcaagcacattacctgtcacctaggcgtgccttaataggtgtttttggtcaacagtatgaaagtgagaataggactgttttgggtaagaacaggagagtggagttgaccttcctttgagaaataaagaagtttccagtgagaaactctggcctatagataggccaaatgaatggactgatgtggggagctaaagttaccctggtagtcatctgataaacatactaatgtgtgacttaggactgtgggacaggcccaggtgataccatctcttcttgctaaggcagaatgatgaaatgaaaccccagcttttgacctagaaagatgtggcattaagtcttactgcctgggatggaaattctggctttcctggttactggctggattgatgttgaaaagggggatagtgattataacagccagcatttaatgagtacttactatatgccagcactgggccaaggattctacaggtattatttcaccacaactggatgaagtagatactgttattcccatttatgaataagtcaactgaggctcagcaaaattaaatgatttgcccaaagttgtatagagaataaatgatggagacagaatttcaatctcagcagcctgactccaggctggagataccgattgggagtcatcagtatacagatggtatctagagccaggaacctggataagattacctagtgagtgggagtagctatagaagaggaacatggaattggttcttggcccctgtagtatttagagatgagggacataggggaaattcagcaaaggagattgagaaggaacgccattgaggtagagaaagaacagagggtgatgtgcgagaatcccagcacagaaagtctattcaggatgagggaatgatcaactgcatcaaatactgttgatggaccaagtaagatgagacctgaaaatagaccaggactagtatttctagttgtgcaggttgttaattgcataatggagtgagtggtatctagaatctctctgacaccctggcatggggttgagccttggcagaagaaggagagcctatttcacataaagacgccatgtgggctaacttccatccttgtgttgcctactggaattagaaacatggaggtcattggtaacctcaacaaaagcaatttgagtgaaatggtaggaatgaaaatgtgattgaattggatggaagaatacttcagaggaaaggcagtgatggcgatgagtagagacatctctggaggagttttgctgtaaagtataaaggaaagcagagaaatagaggtggaagctccattactaccacaaatggaagtgaggtcaagagcttttgtttctttagatgaaaggtattttagcatgtttgttttctgatagcaatgatccagtgagaaaaacagacaattgctggtatgacattcttgagtaggtgagaaaggataggatctagtacaggagtgatggtactagccttagccagcagcacaggtgcttcctgcatagtagcagaggaaaaagcagctgtggggatgggtgcagggaggagggaggtatggaggtgggagcttatgcatgttatcttctaatggctctccatgccccctcacctcactgaaataggaaaccatttcctcagctgagagcgaggatggggaaggtctgaggaaagcaggagaagttgtgaaatagtggcctgggagagaggagagtaaatggtcttgggaatatagtgagattgtagagcagcatgaaagtctggcactaagtttgttgtcatgaatgtaaagggttaatagcatggctttatatttttctccagacatgtttgcttgcatgggtttagggatgtgaagtcagacagttggatttagccaggaatgtggtattgcaaggtaagtaggacaaaaagagagagtgtgtcaggagagttgggaatgtactgaaggaagtgatgggccttgaactcaatgctggtgagcatagaagtgaggacatgaggttggtgagggggcagtaaaaaggtggtaggatcaagactgtaggtcctggtgaagtgggaaaattgtgagagtagggatattagagggagtgaattggccagacacaaggtggtggctggatagtagggtgcatgacagaggttatggagagatcacagccattaacagtaactggtgtgaccatgtgaaaaaggtgtgaggtaaaatggagaggagaccttgaggagcatggagggcaaggcattgagaggccagggtgttgctaaatattgataccgcagagattttgacaaaggaatgttggaaaggcatcacagggaggggaaaggcaaaaccttcaaggactgaagaagggagggtatacatggagggggccgtaaatccgtaaatgactgcaacagaaaggagtagtgggtgccatagtctcaggacatgagattcaaatcagcagagtggttagcaaggaggcagagagaatggtctggaagagacagcaatttagaaacatctgtgaggcacagagaggcactcccttggcccagttgtgtaaggttatatgagaagaaaaacccccactacttgagagagctgtcaggatagcagtgtcttcagagaggaagaactaagtttttcttaaagaaaaaaggtgaagggactgctcaggtgactgatgtaaacagggaagtaggggcgtggtgggatcagtggtctccatggcagaggacagtggtgtagctgtcagggttgtagagtgggaggaaggaggttgagattctttccacgaacagagtccacgcacctactgtttcagacagtctaaactctagagccctagagaactttaccactctggtcttttgattctaaaaaggatgttgacttgtgagaaggtagttaatgacctgtgttgcttaaagcatttttattacttttgactttaaattgcattgatgcaggactttttgtctataacctcaggattcctccagctgaaaaagaaccaggctatgtatattagagtggaattccaggtatgagttctctagtgtgtagaaatgaattaaccaagtggaactctttctagggaagtatggcatttcacagatattacttgtaaaatggggaaaagagggtcaggggaggctcgctgagaaagttcccagaactcagcccagactcggtgctcagtaaagaactgtcttagctgggcatcatggtgcatgcctatagtcccagctacttgggaggttaaggcaggaggattgcttgagcccaggagctcagggctgtagcatgccatgattgtgcatgagaatagccactgtactgcagcctgggtgacataatgagaccctatttctttaaaaacaaaaacaaaaactttttcctccattattgattgccctttccccctgtccctgtgcctattgctgtttctttggatgttatttaatttctctgtgccttagtttcctgtatgtcagatgcgcatgatcatagtccctacttcataggaaagttgtaataattaaatgagataacactatgtgtattagtccgttttcatgctgctgataaagacatacacaagactgggtaacttataaagaaaaagaggtttaatggactcacagttccatgtagctggggaggcctcacaatcatggcagaaggtgaaaagcacgtcttacatggtggcaggcaagagagaatgagagccaagtgaaaggggaaaccccttataaaaccatcagatctcatgagacttattcactaccaccagaacagtatggaggaaaatgcccccatgattcagttatctcccactgggtccctcccacagcacgtgggaattatgggaggtacaattcaagataagatttgggtggggtcacagccaaaacatatcaacgtatagaaatatttaacacagtacatggtacataatataagtacttaaatatgatttgctattaaatgacaagtggtaagttcttggctcccattcaactctcttattcttgccattatgtttcttcttacttcaccccctttctcttacatcttcttccctttctctccttctttttccacacttcctccttaacctatttcctctttccctcccctggctttggttgcagtggcatatgcacctagttcagtactctttgtggccccctgaagtagagaagtcttagagtaggggtgaggcagccatcagaggaaggaaactgctggtggggacagtctcttggccattccatctgaagtctgtagtgtagccatggtggctgcagagatgcaaagggccagtgacaagaggctcaggagctgggaggcctatgttgcagggcaagtttggctactgtgtgatgtgtggctggggcaccagacagtaggcagagcatgctatgaagatgaggatcatttgaacaggaagggactgggctaaatcaccatgtggagggacgagtgaggacatgtgcatgtcctgcccctggtcctgttgctgataccactatgactactcccattcataagggtggctcctccccacggggcatctcctgtcagtcggccttctgtgggagggagcgagtgagcaaaggatagctgagtgtgctggctaagactataaattctagagccaaactgcttggatttgaatcctggctctgtcaccgaatgagaatgtatccttgagtaagttatctaacttttctgtgcctcagtgtcccatctctaaaatggatataattggaacaatacagttcttatgaggatttgtttaaattaacagtttacaaagtgattttcatagttcatggcataaaagaagtacgatgtgagtttttgttatattttaaaaattttaaaaatcatacaacaatcttagaagacttactttcattttaccgatgccaaaacggaggtggagaggttaagggccttggccaaggccacagagctaccgagcagcagagtcaaatctagaacacagctttgacatactccaaagtcctagcttgtaactgcaatgcttaactgcctccctggacattcaggtggagactttgctttctaggagagctgggaggcagggtgaggcaggtgggcaatgtgagtcaaggtgggtggtcagcagttggagtctgagaggttgggagaagtactgcttgaggacacacctgggactagtggctgcatgcccttggcccggctccttggttggggagagcagcctggcttcccaggcccatttcagggacaggtcaagtcccttaggtgcatgaaggtgctgatttcagccagagagctaagccttcttgggactttttccttccttccctattttccaggtgacctcagtgaagttaataacccttttgcacctcagtttcctcatctgtcaattgaggataatactttacctgtctgcttcctgggtattttgagacattgagtagattgtggatgtgaaatcatttgaaaagcataaagcagtacctaaatttaagatactagagtgatctcagaccacattactgtgagggtccagtgtagatctctcaggcctctccatagctaccttgtgctgataatgcccagtgtccaatttcatgaccttttccagctggggtctacagtgatacttggactcttacctccttttctcagtttttacatttcccttggtgagtgtaaagtaatagttgagcagcatgtgggtccctgggaaattattttccgtgtggatttttatttttaagagccagagccaacgtctgtgtccagcctccacagttgtcccagctcccattctgggagctctgccatcttcttggtttcagcccttggcataagacagacctgggctcctgtggctggggagcctgtaactgcctcctctcattagcagacagtcttggttatgtgcttgccctgtggggaacagggaggcagctgaccctttcccctgggtgcctttgtctgtcctggcatactttggggtgtgtgtgtgtgtgtgtgtgtgtgtgtgtacacgtgtgtgtgtatgttagagattctgtaagcccaagaggctaggcctcttgtcagctgccaaagttcttttttccccagaattgagttagccacccaactgtttccattctctgcccgctgcgaagctctacagcagggctgctgtggcaggtcaaaacatgctctgctttgagaatacagagattccattttgagagagatgggaaacaggagcgagtgagtgggtgtgttggatgtagggaaagtgaggacattctttttggtaagctgtgccaaaattggcccagaagcttggtctaaactcaaaagtagggctaatgctgggctgacacccaaatatccaatggggaaagtttattcttggatctagaccctatgagacctagcaatcatttttttttctcatctggaatatggggataattctactccatatattcttcatgtcaaatgagaaataaacttgtaaatagtctaccgtctagtctccaggagcaggaagtgacataaggttgtgattcttaaagtattttgcagaatacaaactgttactaaaaaaagaatcacttgctaaataagtttggggaacactggataaacaatggcatgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatcctcggcctggtaagtttggttatatccccttctatcccctctgtttgcagttctccataaatcttggtaatcctggttggtgctgacgtatcactttgttttgaaaatgcaagatgctaaaggccaggatgtcagattgttgtgtctggattgctgatttatgatctacagccttggcctctccaaagagttttctgagtctttcagtaatgactgtttctttcatccctggggaggcaaggatgcctttcactcatggccacttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatg

SEQ ID NO: 4915 - DNA, 174557 bp, human
agttgctagctgggggcagagacggccacgcggttgcaggagtaagagatccctctgtggcgagtgcgtgagacgaggagtccggcgtccctgccatccccgtcgccctccccgcctgctcggccccgctagctcctctccttgcctccgcgtgtcccctagctctgaccccttttggctcccggttcgctgccgcagcactgccgggtctccttggcccccgccctgaccctttcggcctccggcttcccctgacccctgcttgcttcgccactgccccgttcccgttttcttccctcgctagttacccctcccgcttcctaattcccggtgcaattgcctctttgagacctcttttttttttttttcctctccttccttttagattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaagtgataagagtcatttatgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctgaaccctaggaacgactggcactcaccctggctgcccctcccttccagcccagcccaaccctgccgtgccctgggctttcacaagcaggaattccagccccagccaggtgccctttctgaatcacatcagtggaccatgacccagctcccttgccttctgtggtagttaatttcccaggggcctggtgacactctttcctggaggtggtcgcataaactttctcatctacactgtggtactttggggaaatacttttacaggtttctcttaatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataataccttgcatttatctaacaattactgtttataagatactttcatatacattgttacttttagcttaggcctggagaaagggatgttaaaatgtttcctgcaacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttacccgcttttggttcactgtttgattttcttacttcctctctccttgctaaaagtgtagaatgacacacactcagaaagtcctgagctttttgtgaaaccccttgcaactcactgaatacacactgttgcattccggttgttatgtgatgaatttgttttagagaagacctgatggatttgagaaacttggctttctgttttcccccttgacttcacaccagacacacctcctcattctccatctgttgtctggagcactgattatcattcctgcttggaattgaagttggtgggtaatgggtacaataagggatccagccatctgctgacagcttatcagatggactgcgtcctgtgtcatcagtccagggggatacaaggggatgatgtttatatgggcctcactagtgaggcatgacattcctttttagtttgtttctccccccaaggaaatttgcagagaatttttccatctttcattgttacagtcattgggggtgtccatataaagagaggtgctgtggattggtgaattaaacaacccacaggcagccccaggatttaaaattatgatgctagttttgctcatggcttgctacaggaacctcagcaaactatttaaccttttcctatctcagtcttctctgtgaaacgggccacatggaaatgaagcatttgaattctctgaataattatgtggtcacttaaacagagaagctgggcaaagctggtcaaagatggcagatgaccaatacagtttcaacttcagactcagaaaccgacaaagctcaactccttatacctttcttgatagcttctagaaggcattcctctaatcatttttgttacttttctctggatccttgcctgtgtctggatacctttctgatgcatggcatataaaactggacactaactcttaccagaggtccagcctacaccaagcagagaggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcctttgacctcactttgagagatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaatgaagtgtggtgccatctttctacctttctttttcatatctcttcttccctgtttccaagtctgtccacctgatccaccccacacaagttccaaaacaatcctttctataattcaaaatgcccatctcatcagaggagatgatagccatgggggattaggaagaaagcagttttatttcagaggttcatactgaaatgtgagtggacagactccactgggcgtcagggagaggatgagttttaaaaaagggccttgttaccctaacattatatctaattggtagactgtgtctagtgtttttaagcagatgtcctttctcatgtgccttgctcaggttttggcctcttctctcccgctaaagcccctgatcaggagaactggagttatccatgccttgccaccctacatgctgacccccagggtttcatattaatgtaaatctccctccacagtgcttggatgcagcagttaatctgaaggcctggcgaggacccctcttctgggcaccagtcagtcctctgtgtttactcagctctttcctggctacacagggcagcgcttgcacatctgtcagttcatgggcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctccttttcaagactttgctctggggcctcgttttcaagactgaggtctggggcctaagccaccaatcactagagaaggatccccttaagagcagccttctggggcctagaccttgatcatgtgatttcaggccttgggatgtggggggtgtgctgtatcctgccaaggccattggaaggcctctgggcatattcccaagcattgtgggtaagaaggctgtttcttagtcttggaggtgggagaattgagaaagctaaggtcatgttttctataacctggttcctggaagaggagctggtttagagggcatttctaaacaaacagcaacccaaataaacagcagcgcttggaaattagttatgaaagttcacacattctaagacctagggaagattgtaacaaagggtcctcttcatatcagcacttgttcattgttggtttgcatttgttaagagtttccttttttaagttccaggaacttgagtgtgtgtgtgtgtgtgtgtgtgtgtgtgtgcgcgcctgtcactttattctctgcaccctgcaggaatgttgctcagagtcatgtgcacaagtgcctcattatcagcagcgctttcacacttggtcccttgggctgccactgctactggctgctgcttcatgtgggtatttctacctatttcctggagccccagccccacagggaatgttggcaccctgaggaaagggaccgcctctacatttggatctcccttctgctgcagggcagctgactttactctgctttcaagttcacctttcctcagaatagccctgcaagctagcaccaagccaaggttatgtttccttgcttgcatgtggggtttctggccagtcagccaagtgaactgattgacccccagccctgtggggaatttcaggggggtattgtcttggtcatcggagtcaggggtggcctttaggccaaggctgcattagctttgtggagaagaatgtgaagcccgccgtgtcacagggtctgctgaccggctgggtagtgtttggccatatctcacagccagtgctgtgtttgctcagatggacgcacatggaaaccaggctaggatcatcttcccaaatgtcttactccctgctttgggtctgtcctgaaaaacaatttgcaaagtacattgtggtctgcacctgttgttttttcatcccccttttccacagtcagtttgcagtgaatggaggattaatcctggctcttgccacttgtattttctctttcccttctttccttgacgttgggttcttgcttttcagttataactgtctgtggacattaaggacagctggtgcccctgatcatttaggacctcccttaggcctttaaaacgctggaaatgtgtaacagggccggatgggcaaaaaagagtcgaatttaggagaaaactcactataatttctggttatctttgtacactctcagaaaagtgaggagtggtagtaataacacttgtaacatttttgaatacacgttaattatgctttaggcatggtgcttagtctactgcctgtgtattacctcatttgcagccttccagaaaggttgttttttgtttcatgtaattttttgtttttttgaaacaacgtcttgctctgttgctcaggctggagtgtagtggtatgaatatggctcactgcagccttgaccccttgggctcaagcgatcctcttgactcagcctcccaagtagctggaaccacaggcacgcatcaccacgcccagctaatgtttttgttttttgtagagatggggtcttgccatgttgcttaggctggtcttgaattcctgggctcaagcgattcttctgcatcagcctcccaaagtgctgggattataggagtgagccaccacacctggcctgttttatctaattcttcttttctttgcttctagctgatttcccctttggtagactataggcactggatgttctagctgtactttctcaggttgttaaaatggcagagtgataccaaatcagagctgaaagaaacctctgagaacaactaatttgtttctttttcatcccttgttttccagatgagcaaactgagacccagagaggtgaagtgatttgcccaaagtcacacagctaaatagaagcagagctgagtctcctgactcccatttcaatatctctctataataccacacatggcctccttctatccttaaccttccagcatgaaaggaactagacttttcttcttgctcactattagagaaatggaaatcttgtgctttttgagcatcattgtttattgccttcttgaaagtgaggatctcctggctgcaggccacctccttcctttctttctttctttctttctttctttctttctttctttctctctctctctctctctttctttccttccctccctccctccctccctccctccctccctccctccctccttccttccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactctatctactactcgaccctttacactactgccagaatgatacaagtaaaatacatgttggatcatgccattcccttcctccaaaacctttgataactccttaatgccttcatcagggatggtaaacacatagatgcatacactttatattgtccctggccgactgtgctaatcaatcataggcacgctttcccagggagagtccaagtagatttaaaatctgtttagcatagcattctaggtagccacttatcaatcagtcagagctggtattaatatatagactagggatggcacatagataaagcctgtagagaaatcttaatctccttatgataggattcggtatcttctgtgattttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgtgtgtgtgtgtgtgtgtattgagtgatatctcaatatagttatttcctcctctttattcccaaagccttgggagtggactgcttgtaaagtgttggtcccatagcctgctagttagttgtttacttgtcaagagagatctaagatgtaagattctcaataatagtaactacctttattgggccttttcagggataggttttcagacttactctgaatcatacagcttgtaggatgggtgccagcactaggacccatatctgccccttttgagcagagtgcctggcatataggtatttgatcattgtcacatgatgtgacaaggagctttgtttctttgtgcaatgcttctttttattaaaaaacccagcggtggtaaaatctgacgtatttgaaaagtctggtgggagagaggtttgaggagaactgcctggcattcaaaaagcttatgatatgttagatagtgtgtggtgaatctagatcacataacatgtattaagcaattactccaggcctagtcgtactagagagatacaaaagtattagatgtggtttctgcccccagggaacttattatcaaggctcattaacagtctgactactgtattttcaggtggcaagtatgtacagaatttatgaccagaaaatgctagagatcagagaggctttcaagttcctgaagttcaagcccgtcgttttgcagatagagaaagaagcccagagcagaaagctgcttgctgaaggtcacaccacttgggaatggcagagccagggctggtgtatatggccttaccctttgaggtcctattacactctgttctgtcgcccttgaaggacaggtgaacctaatggcctgtgttaaaactttaacgatatgctttatgcctccaggcctccttatggtttgggggaggggaggttaaattttagtctttcttaaaaccttgagtgggaagggccagcactggttacctctggctcaagcccaagagttctaaagatggctaattttccctttactgagacaaccactgattctagtctaattagggcactttcctactcctcctaagggtctttcccaagctcagtgtgtttatgacttttctacttcagttcctcatttttttttttcctttttgtgaaactcaccttaaagacaagaggtgcctgtccttatgggtgggcctgagagttagaggagtggggccagttcctagtgatactagcatcaggctggttcttttggccttgtcccctgctacttcccaagccagaaatttagatccaagtttggggctttctcagaaggttcaggtataattcaaggtagaggtattcttccttccagacccctctccccacacagttagtattagggtataattctagtcaccactaacatctattgaacgcttaccaagtgccaggcatcctgtggaatagatgctattatttgcattcccattttatagataagaaaaataagggtcagggaggttacgtaacatacccaaggtcacacagctagaaagtgaccaagctggtatggatgtgtagatctggctgactcgttactgttaggctaatggagcctaacatgaaaataagttactaattatatttttgtattgacgaagaaccatttgccaattttctgcaagccaatttaaagaactggttgaaagagaagcatcctacctatagttctgttccactgtggggtggactgtatcaagaggcttgccagtcacctgcatttgtcaagtaagtcccttcccttctctgagattcagtttctgcctctgtaaatgagagggtcagaccagatggtatctaagaccttttctggcttcatttgctacttcctggtagaatggaaaaattgtagaattggatgaaggacacaatgcattagaaacacaaatgtggagagaatacatagttcatcacggatgggttagttagccagttacacactgtttctgttttcccttgtgaatttataatgaaacattttttttttcttttcagtgagcttcttgctaacatcagaaagtactagctttccttttttgttgtttggttcttttgtttgttggagacagggtcttgttctatcactcaggctagatgcagtggtgtaattacagctcaactgtaacctcgaactcttggactcaagagttcttccacctcagcctctcgagtaactaggaccacaggcacatgccatcgcacctggctgatttttaaattttttgtagagacagggtctcactgtgttgcccaggctggtctcgaacttctagcctcacgtgatcctcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttttgtttgtttgtttttgtttttaatgttgctcagtcatgccacgaaatgggtacctcctaaacactaacttggataccctgctggtttgctgcctttcagttttctattcacataattattgtttgcattcccattctaattttggcctctggtctcagtaagaaggagaattgaaatactcagtgtcacactcattacacccacgaccctcattcatttcacaaactaacctcctgtatttcttctcttcttctggcttggcatagggcttttgacttagatctgagctcaaagctaatttctattactcatgagctgtgtgcctttaggcaagtcacccaatcactgtcattatgtttttcatttgtaaaatggagctaaaaattctatctacctcttcaagttatttagagaattatgtgagttaatatttctaaagctctgggaacactgtgtggtacatattaggtattcaaaaaatattagttacagtcttcctccttgctccccaagaaatagagccagtaacaacaacctttcttctaatacctcatgaacttctcctggcattagctgtctgaaggggctgaggtttgccttttcttttgacgatggagattagtcattagaaactctggatttcatcctcacaggaaacttgaagttgttgacttttgttccttgttaaagagttggtacgactggggcggaaatctccagagaaaagggcgtgttcctctactaattactctgtagacggcagagggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcaccttgatcatgatatattatcttttttattgttcctggatatggtttgctagtattttacatggtattcttaaacactgtgagtgggctgggcgcagtggctcacatgcctgtaatcctagcactttgggaggccaaggcgggtggatcacctgaggtcaggagttcgagaccagcctgaccaatatggtgaaaccccatctctactaaaaatacaaaaattagctgggcgtggtggtgtgtacctgtagtcctagctactcgggaggctgagacaggagaattgcttgaatccgggaggtggagattgcagtgagccgaggtcatgccactgcactccagcctgggcgacagagcaagactccgtctcaaaaaaaataaaaataaaaataaataaataaataaaataaaataaatctgtgagtgaatctggctctagttttcacttttcatactgcctttgtcaggttttcttattaagtttgtgctagcttcataaaatggattggccaatgctgcttcctcttcttctaagctttggaaaagtttgcatgagatcagagtgatttgtttcttaaaggtttgttagaacttgcctataaaactatctgggctttgatattgtctttgtgggaagattatggactactgattcaatttctttaatggttataggaattttcagacattgtatttttctttagtcagtgtctttaatttatgttttgctaggaatttgaccattttgtctaaattttcaaatttattggtttaaaattgttaatagcgtcttaactataaacactacagatatttaaaagatttcttccttttctctcatactattatttgctactaaaaaatcaatctcactagtagtttgtaagttttatttatcttttataggaaataattgagactttgttgatggaactgttacatgtttgttttctattttgttaattgctgcttattttaaaaatctgttttctccttcatattttctttggagttatgtctcttgttcttttcctaacttaggtgggatgcttagcttatttatttttagactttcttatttgactatatgaattaaaaggttaataatttttgctacctactgtttagctacattccactaattttgatataacattttgttattgctcagttccaagtattttggaatttccattgtgctttcttaactcatgggttgtttagaaggattaacagttttttcctaaatgttttaaaagtcatctttttgttgctgatttctaacttaataacattgtgatcagagaatgtgatctgtatgttctgtttctttgaattttgttgagatttgttttgtggcccagtatgatacagtgtccactagatcaaccttgttaattttgctgctcttcaatcaccttaccttattttttctctgcttaatctatcagttactgggagattttttaaagtttaccaccacagaggtagatttgtctatttcttcttttagtactgttaacctttactttatatatttttgaggttgtgttattaggtatagtatgttaatttttgcatttattgttacatctattgatcaaaatgttcaatataggggtcccgtggcaacttagagtgtggatagatctacatgctataagggtggcttggtaatggtgaaagcatccctctgggtgggctgggtaaattggattttcagctccagggaagaaacacccttaaaatcaaaattgcaccttcttgaagagttcttaaatttgacattgccaaacaaaattaacaccctcatatcctcaagtgccagaggcttttgtcgttattgaaaacactcttaaaagctgcattccttctgggatgcatgaggggttgggaaggaaagctttatttttcatgggccttacagacattacttctggttggtcagacatgtttcagacccttggactttcttcttcttactgcctagtattttctatgagacttgagccaaatcctgttacctctctgccttttaggttcaatgactggttcccttttcccctgacagaagtgaggtgtggagaaattgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgccatttaaaagatagtacattcactgggtgcagtggctcacacctgtaatcccagcacttttggaggccgaggcgggcagatcacaggattttgagactagcctgaccaaaatggcgaaaccccatctctactaaaaatacaaaaattagccaggtgtggtggtgggcgcctgtaatcccagatactagggaggctgaggcagtagaattgcttgaacccaggggacggaggttgcagtgagctgagatcgcgccactgcactccagcctgggcgacagagcaagactctgtctcaaaaaaaaaaaaaaagaaaaagaaaaaagaaaaggtagtacattcttttcaaaaggaactattatgatacattgtgtcttataatttttaaaaattttaaaattttttattatactttcagttctgggatacatgtgcagaacgtgtaggtttgttacataggtatacatgtgccatggtggtttgctgcacccatcaaccctttgtctacattaagtatttctcctaatgttatccctcctcttcccctgcaactgccgacaggccccggcatgtgatgttcccttccctgtgcccatatgttctcattgtttgactcccacttatgagtgagaacatgaggtgttcggttttctgttcctatgttaatttgctgagaatgatggtttccagcttcatccatgtccctgtaaaggacattaactgattgttttttatggctgcatagtattccatggtgtatatgtgccacattttctttatccagtctatcattgatgggcatttgggttttaacattttttaaagagttgaggtctcactctatcactcaggcttgagtgcagcagcacgatcagggctcactgcagcctcaaactctggtgctcaagctatctacccacttcagctttccaagtagctgggactacagatgcacaccactatgtccagctaatgttttatatattttttaagagatgggggtctcactatgttgcccaggctggtctcaaactcctggccttaagtgatcctcctgcctcaacctcccaaagtgctagaattacaggcatgagctgcagtgcccttccctagtcctcctttttataataattttaaaaaggtttttttgcttattgttattatttttaattaatccataatattttatatatttttgaagtacagtgtgagattttgatacacgtatccattaaccaatgtctccctaatccctcctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttctaccctcctcggaaacttctagtgctctcagttacttacaaaataaaatccagaattggtgagctgttccttaaggctcttcatgatgtggaaatagacctcttagaaaaaggttgcaaaagcaatgcatactcattatagaaaatttggaaactaaagaatttggcaaactttttctgtaaagggccagatagtaaatgttttaggctttgtgaaccatgctgtgtctgccacaactactcaactctgctattgaagcacaaaagcagctacagataatgccagtatgtgagtgaatgtgtgtggcagtgttctactaaaactatatacaaatcagtcagtgggccacgtttggttcgcgggttattgtttgctgaacactgctatagaaaataaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctcaatcctatctgtattcatgtacctgtctgtggagtcctccctagttcctcctactcgatatgatctcttgcctttgaatccctgtagcactgtgtacctctcttgtggtatttatgtctttctgcccctttttttggttatctctgtactggctttatgcctatggcatggacactgggtaatgttatctttgcattgactcccagagcctagtagagagcttagtgtacaatgggctgattagcctatcagagctatgttgaaaggtgcctaaggtctgctgcagatgacctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaagctgggtatgtatagtgacccacagtaacattgacattgtagttttctggaattttggagaggcagtctagaccctggtagagccgtagagagagagagagagaggggaagccataagtttggttcaaaatggaaactgattccagcgggaggtgtatgttgtgagaaaagggagatgatgccagattggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacaggcgtgagccaccgcgcccggcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcctcccttttgggaaaacatgctccatttaaatcatacgtagtaagtcttcagaaaccctgaccctggaggggctttgggacacaactgacaattaaatctcctggtgtcaggagatcttgcaactgagaactgagtgccccttccacctcactcataattgacaggggccagtgccttgtgtgggcctcacctcacctggcatcaccactcctcacccaaccttacctcaccttaccccaccttaccccaccatacctcacctcaccttctctcctgctcttgagagacaactaggtaactgtgagtagcacttctcccttggcatagtgaagcagcttcctcactgatgctcaattcaaggaaagagaaaagttcttgtcttgagttaccatggggcgggggggaaggggaattttttttaaaaaactactttgagcttcacacttaagatttttacaaaaatcaattatatttggtttctcttttgatcatgaaggtggtatagtttaagggttgaggcatggatactactggaatcagacactagtggactagaattttggttctatcacttgctagctgtttgaacttggggaagtttcttaatttctttgaacctcagtttacttgtctgtaaaatggggataataatgcttgccttgcatggttgttgtaaagattagagagtgtctgtacagcatgattcctgggacccagtaaggactcaataaaaggtagttgttattattaaagcaggtcatttatgtttgtaacaaccacagggttaagctcattgtcccaatatccttttatctcatccctcagcatgcttgcttttgccttcctgaagctgaagatatttatcctcagggcaagagacattgggtgtgagggatttaaggagacagattttcttgacagagggattcttaggtcaagatgagtaaggaaaactcgagagctggatgagtaaggaaaactcgagagcggcctttgccaaggaaatctaaagcaattgccaccctgttggagaggtttctgtcctgtctgaaggtaggaatgggggatagatggatgaatggatgacagccttctgctagccttttgaagagtacattcccaggaaaatagcctctactttctgcagtgtgggagtgagggcgggggatggatattgtttttgagtgaaggaaaccttgtgttccatacttaagcatcatgttcccccaccctgggatgctctgttggcctgatttaaggaaagctttccagttgatcttttaatcttcagaaataacaccagaaatcagttatgccatcactttccttataaaactaactagctttcatttagcagattttgttctagggattcagtgtgtctggatattgaatttttgtactgccggggcaaggttttctgagagtggtatgtttgatgtgtgtggataaggggttgggggtggctcagagggtgagggtgtggagcattgtcttcaaaatccctgagcaaggctgagggtgtttccatgtctactgccctaatgaggattctagcgaataggggcagtgctggctcattcatagatattaaaataaaatgttaagtgggcttccttctaagagtcaactctaaggcattctctccaaatttacttgtctctgttgctatctcttttgttagaatgagaagatactcttgaaaaactgtttatgatacaaatctatatgttaaatcctacttttagtgcagagaggcagcttgcaaaaagtacattccacggagagccttttagacaaactcctttggtaatgtgaattgtagcctttgaatttcttggttgttaaatcttgatttttatgtataggtttgcttcaagcagtttacctattttttacattttagtagaacgactgggtatgttccttttataaaatactcagggaaatggaaccagtgtcatggtctcccttgatctaagttcccagagacttaagacctcagagctgtagcagcaactcagcgagttccatcagcataccggttcccagcagcttttctttatctgtattttaaggagttgtatacagagtcacttttcatgatgacaagatgcagggtaatatgatttgaaaaaagaactgaatgaatcttttttttcccctctgtattttaatggaggcaaactgaatgaattctttccttagtctcttctgctggtctttgccttggttgaaacctccttttccctttgctcagccaccctctggggttacctgctgcttgggctgaagtcctaaggcttagcgacaagtaaccatgtcatgttgcctctgaggctagtgggcacagctgaacactaatatttgggccctaactttcagcttgatttgaagaaatgccactgctaaatgtcatctttttttgtggatccctatttgactgactctttggataaaacaggtgggcaggcaacaaattaagtgggaaatgtttctgtgaaacaaatccgtttaatagtgttacctcataaataagtaacaaacacaactctaccccctaacccgcactagcccatatagccagaatggaaaagtagattgtttctttgtcgcttctgttatggttttacttaaatgaattatcagatcagacccctgtttgtacagaagtttcaaaaatgtttgttgtaaattgatctgagccaatttgattttccacagttaattagattctattctggtaggtatcattaatctccaatagtcagaggtaggtaagtgctataggtttttcccccacaaccagtagattacagtgaaaggaattctgattaaattctgccacgtaactttattaataatcaggcacaagacagttatacagcctgacctgtacacccagagacattccagtactttttttgcaaaccaccatactgtgtgaagggttcaccggagatagatgtgacgatattttagcagtaggactcagcttaccttctaattagagggcacatctgagtcctccattaagtgtctggacataagatttgttgggactcctgagcctaaggtgtcattttaaaggggtgaagaatgttgggctaaccagagtcttatatccaattcatgcaaaagtgggagcaactgaatatttctaaatgatatacctgtcctgaacactagccagtttccctaatgaaatatttctagtatccattgttgtaacgaacaaacgatcagaagtacttcagagctgaggcatgtaagtgtgacttttttccccattagaaaaaagttaaggtatatttaacatacagtaaaattcacccttctaatggtacagttctgtgagttttgacaaatgcatacagttctatgaacactccagtcaagatagagaatatttccaccacccccaaagattccgctgtgccttgattgtgggattttttaagagcagctttactgagatgtaattcatataccataaaattcacctacttaaagtgtgtaattcagtggttttcatatactacatttaaaaaaattagttaaatatatacatataacatacaaaatttgccattttaagcatatttaagtgtacacttcggtagcattaatttcatttgggatgttatgcaaccaccactcctatttctagcacttttttttttttttaaatcacaccaaacagcagctctgtacacattaagcaataacttccaattcttaccttccccaggccctggtaaccactgttctactttctgtctctataaatgtgcctattctaggaacctgttatcggtggaatcatataatatttgtccttttatgtctggcttgttttacttagcaaaatgttttcaaggttgtagcatgtatcagaactttgttccttttttaagggtgagtaatattatattgtatgtatagatcacattttatttatctgtcagtggacatttaggttgtttctaccttttggctattgtgaataatgctgcagtgaatgttagcatacaagtatttgtttgagtccttgttttcagttcttttgggtatgtatatacctaggagtggaattgctgggtcatatggtaattctatgtttagctttttgaggaactgccaaactgttttccacagcaactggccactttacattcccaccagtaatgtacaagggttccaatttctacatatcctcaccagcacttgttattttctatttttaaaattatagccatcctagcagtatgaagtggtatatcattgtggttttgttttgcatttccctgatgactaatgatgttgaagtttatttcatgtgcttattagccatttgtatatcttctttggagaaatgtttgttcaagttctttgcccattttttgaaaaaactgggtttttgttgctgagttgcaggaattcttgattgtaggctttgattagaaatttcagttgctaactaatatcacccctggagtttgtattctcaattaggggtcttcagatgttaacaatggtgtgtggtaaatgtttaaagctctgatttatggcatttgccaatttccatggtcaattccaagctaccagtctgacccctcactaaggtagcaaaggagttgggaagagatgtacacaatcaactctttctagccagtgctattgggcttccagcatgcaacagaatgttaactcaccaccctatggtgtagaataaaactaacacagaggcatatttatcacagtgtctacactgaaactatttaaattaaattagacataactaaataattttcaattacaacactttagctccttcaataaaagcaagaataattatttgttgagcacatcatatgctagatgtgctccaagtattaatagatattattagtaaatagaggaggaaatgtagaataagttagtagtaggctgggacttgaagtcagactccaaagcccatgtgtttgatctctttactgcactgtcttctatcccattagtggaatttacttactgaatgttgactactataaacagagtagactactttcttctaaccccagggatgcttctgtgttactttgtaccctccagcctctctaaatcctgttcaaattggaattgaaaactaaagctgtggtggtaccacatatcaaagaactgtaaggggttaaaaatatccttttcctcgttgcaaaaaaagcatgtgttgtaagaaaaatttaagcaagcgagaaatggcaaaaatagaaagtgaaagtcccccataaacccatctgccagagataatcattattaacaactagcatttattctttcagagctttttctttacacattttttttaaaataacaatgggatgattccttataatctgagtctcttttcacttgataatatagttaggctattttccatgccagtgtgtatagctctactttattcattttaacagctttgcttcattcattttaacagctacataatatcccttgtgtgaaggaaatgtaagggattttgaagggctattttgaagaagtgatgataggtggcacatgggacaaaaaggttgaaaactactgttgggtaccaacaatagaggcactatactttccatttctccccccagaggctactataacttacctgaaaccataagacgaaaatccatgagcactgggaagagttacaggaaaactcaaactaagctagtcagggataattgagagataagactacatatcaaattccttcacatgtctttagggctttacagccctggtctttgaaactctatttggaatctttcttaatctccagtaggccctgctttgagtttgggaaacattgttttccaggaaatacaaccttttaatttcccctcatctgttcctcatcttgagagatggccaccatcatgttttcttgctgtgataatctgtcaggttttttttttgttgttgttgttgtttgtttttgagacaaggtcttgttctgtcacccaggctggagtgcagtggcgtgatcatagctcactgcaaccatgaactcctaggctgaagcaatcctcccaccacagcctcctgagtagcggggactgccaccattccttgctttttttttttttttttttttttttttttactttttttctacagatggggtctcactatattgcccaggctattttggaactcctgggctcacatgatcgtcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaactgactgaacgcttgcagagagatgggctaaaggccagtggtatcagtttatcaggatttgtctgccttacactctcttatccttccctctttaccccagggagctggcagaatggtgtttcctctgtaatatgacatatttagattcttttaccagtttaaagaagttaatttaatgggggtaaagggggctaagtttttagggttggggtcaggtactatcctttataagaaagattatgggtgtttgaagctcatgaatggacatgtcattatctttcaaattacatgctaaggatcaggtttgtatcgtatgtattttactatgccttctggtccatatctcagacaaaccactctgtgccagctgtgctaggtgccagcagccatgaactgtgccagagaccctgcctccctggcttaggttgattggactgagtggccacctgtcaccaagacagcccatctgtcacctagcaggtaacatgggcttgacgagctgagagctgggccttttgtattcctctcttaggaaattagaattgggaagctgagagcctaaggcagtttgtaacggaaaagagccaaaagatgatggggagtggagcagtcatgacagttcatgtcctagctagttttttgaagggacagaaaccatgagcaaacagagggaccttgcaagggaggaacagagatgccttgagagacagaagagctgtttcctacagacaccatgaacccagaaccactttccagttctcctgaggcccagctttatcctaccctaggattcaaatgggatacctgtattctttccacaaacctcccttttcttgagccagcttgaatgagactctgttttcccacaatggaaattatcagaccagatctaggctcctacctttacaatcgacttctgggttgagtcaacaacagttggtttacatttaaggctgacatgaagtgctgaagactattctaggtattacggggaacagtggaaaaacacagatacctgattatttctgtcaagctcagtgctgacgttatgggctttgaatccgtgttcctggcaaacagtgagaatgaaaagaggcagggatcctgactgttcatttatcacttcacagctctcaaccaacagggggccttctttatcctatttaacctctcagtagagtatttgccttttgcttattcctctttccagtcaactcttgattattcatgtaatagaggaaagcattaatgtgaatgatagaagactgccccaccttggcctctcttctctgccacagcagcatccagtcacagaaatggaaacaactagcaggagaggtaaggaggctgaaaaaaggtgggatggggccaagcaaattaacattgtttcttctacttttataccttctttctgttaataaatgctgcctgtttgagtttctcttctggtgtcactaggagattgctggaacagcaatgccatttgcttgatttaagtcaaaatatgggatcttttaaaaaactaaaatagagttgggggcaattgactaggctgttagtttcctctcccatctattgtacccccttttgtcagtgccacccagctttcttgttggctgagtttaatgttgggccactagcaaccattctttgttcaggatttgggactcagctagccaaaatatccacaatagcatttctcaaagtatggttcttgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagcagctgttttggaattagaacttaggccttctgacttccaggcaatggtattttcttccagaggtatacatttctgtaaataaagtctgaatgcattggaataacttaccctgggggttatttgtagcagtctcaaatcatttgatcagggtcactactggtgatatatagagggaaataggagagtgaagtaatgcagaacataccttctgtaatttagatttggatcatttttgctgggcctggagaggaggagctaggggagtacagcttacccatggcgctgcttacggaatttagacataagagatggctgttcattattctgggattccacatctgtacagagtgtagaacataactgaatactcagtaggtatttcttgattatgcgatttgctaaaatcactctgctagtgtgttaaaaataccatttagagttttctataccatttaccatttaattgataagcatgtggtttgataaatgttgttgttattattgttattagaagtagttttatgtagttcttatagagatataagggcctttagatcatttgatttggggccctgcctcagctattaaaaattgcattgtaccttaaatacctgttgcctaatattgtttgccttctcattgtgactcttgggggtttctgctgctcagaatagaatggaatctttcataagactggattaaagggcatacggcctaatgcagcagtctctaacctttttggcaccagggacaggtattgtgaaagataatttttccatggactgaggtggggggtgggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaataataaaggaaattcattgaacaccgttaagaaaagataatgcatgttttccttcaaaccatcaatgctttgccccgtcactgatttgcttgtgcgacccttcttttatgtcactctgaataaactcccctttgtctttctgggccgagggaaccaaatgactatagagggactcttattggagtcacacatttctttcctccttgtgactgccaaaccaccaaactctgggccatttgcatgtgtcttaatttctcctcataatgtggcaaaacacgttttggtgctaggtacgatacaacccttcctggagtgaaccaaatgtggaaagtgctgtaatttgagggagttttcagaaaagagcctcttctggtacagaaaggccctttttccttttttctttctcttttttcatttatgcctcatcatattttgtccactttcagctcatctcaggctgaattttccctttgatgtctgctttatagaatagcccttgcctgagaaaagagaacaaaaggccaactctgtggctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgttatttaaaaattcatacaattttaaaggaatagaatagcatatatgattccctccaacctctgacccctgatccactagttcttctccccagaaacaaactgccattaccagattcttggaaatcctgagaattactgcatgcataaacaaggcttgaatattctaaaatggcttttgcttaggtaaccaagtctatccatattgtatggagacatcttgtttcatttattcattcagcaagtacctgatgagcatctcatatgttccaggcactgtgttaagttctggacctacagtgaggaccatcacacagctcctgctctccagaagcttatggtcagcagggaagatcaacatttaatgaaaacatagctaaatataaatgagaaatggtgatatgtgttgtgaaggaaaagaacagcatttacatgcatctgtttttttttttttttttttttttgagacggagtcttgctctgtcgcataggctggagtgcagtggcgccatcttggctgactgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttcccttctcttccagcttatgtcctgggctgggctctggacagggagcagaggcagatgtgcgcatgtgttctggaggacttttatatgtccgatggtgtgttaggcactatgtggagtggaggcagagggaactccagaaaagataaattatcttatggtggagacaaaaggtagtattggcaacaaacatgacctctggaatcagatagttttgggttccaggcctgactctttgactcacttattagttgtgcgaccttaggcaatttatttaacctttctgtagctcagtttccttgtatgcaaacaggaggaaaataataatctcttacataataggattgctatgaagaatatatgaactaatatgtgtaagacattgactgtagtgccaggcacctagtaagcactcagtaaggaataactactgccattattgttgttactaacaacagtatgagactaataagtgattagtgtataagtaccaacaaataccaatggagttcagaaaaagaatgcttaatttttgtgacttatccaggaaatctctagaggagacagaagaagtggaatgaaatattccaggtggagcaaatatgaaagtgggaggctgaactgaactggagtggggaacaaaaagaagaaacaaacgcaacatctggcacccttgagctctaccaccagctcacctgttgtcactaccaatatgtccagtcctttatggctctccattttggagtgccctgaattactggctgcagttttgacttggccagctagttggccagctgctctgactgagcttgagggtgtctgtgccttggtggagttgacacgggtcctaactctgcaacttggtttgtaggttcaaagcctaatttttatcagcttacccagggctgttggtttctagtggattgggtcacactccccaacattacaaaacacttcttaataaatcaccaggctgataagtcgattgatgatgagagagagacctttatagagatgagaacacttgtgtgtatcagccctttctgatatcaaggtacctgaagccaaattaaacagggactgttttataacctaaaatcagaacctaatggagttgaaaagtctcatgagcgagaccatataggctttggtagtccatggaaaactgtacctttttgcatgtctgtcatagctttgtagtgtgaccagaatgtgtgtcctgttctctctccactgctggagaaacatcagtaacaatttttctcttggatgttcctgttttcaattccatgcaaatgctgtttgtgtgctatggccatgctattctcttgaatttcttttttcttgacaagatttttgagttgcctacttctcagcgacaacatagtgattctctcattgagtgttctttttggctttgttctcaaacactaggaatgtttccaagcagggccgccacgaatggctatgcactgcacaaccctaggagagggtgccattcacatagactataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtggatttgatttgcatttccctgatgactaatgatgttgaacatcttttcatgtgcatgttgagtacccgtgtgttttctttggagagatgtctgttcaaggttatttatctttttattgttgagtttttttaatactttagctatttttaatgtatatatttaaggttttcaacttaatgattatatatatatatggaaatcaccacaatcaagataacacatgcattacatcatagagttatcatttatgtgtgtatgcgtgtgtgtgtgtgttggaaatacttaggatctattcttatagcaaattttaagtatacagtacagtattttcacctatagtcgccatgctgtacattagatatccaggacttacttgtcctggaaaactaaaactttgtactttttgactaacatcttactttcccagcaccagccccagctaaccatcattttatactcagcttctatgagttagactaatttacatttcatatttatgtgacatcataagatatttttctttctggctcatttcacttaacataatgtcctttgggtccttctgtgttactgcaaatgataggatatccttctttttaaaggctggataatataccacattttctttattcatgcatccatcgatgaacatttatcttgtttctatatctttgctattgtgaataacggtgcaaggaatataggagtgcagatatccctttgagatcttgatttcaactgttggataagtattccagaagtgggattgctgtgtcatagaataggtctttttttttttttttttttgaaactatactatttttgataatggctctattgatctccatcagcagttttccagggttctgttttctccacacccttcccaatattgccatcttttgcattttttataatagccattctgacaagggtgacatgagatctcactgtggttttcatttgcatatccccaatgattagtgatgttgagcaccttttcatatacctgttgtccatttgtatgccttctttggaaaaatgtctattcagatcctttgcccattttaaaattgggttatttgtatttctgctattgagtttatgagttctttacatattttaaatattgacatcaaatttgtggtttgcaaatatttgctatatagctttttaggttgatgtagtcctaattgtttttgtttgtttgttttttacttttcttgcacgtgcttttgatgtcatattcaaaaaatcattgccaagaccaatttcaagaagtttttcctatgttttcttctaggagttttatggtttcagatgttacatttaagtcttaagcccattttgagttggtttttgtgtgtggtgtaagataagagtctgatttcattactttgcgtgtggatatccagttaccccaacatcatttgttcaagcaagcatcttttcccccattgtgtatttttgaccctctaaggttctttattccttttcatccttttttttctttttctcttctgatgaggtaattttaaataactgttcttcaaatttgctggttctttcttctgcttgataaatctcctgtttttagttgagtcattgtattcctcagctccagaatttgtttggctgttgtttacagtttctatctttttatttaacttttcattttgatcatacattgttttcctgatttcattgagttgtccatctgttaattttcttttttattgttgagtcttaagagctatttattctgaatactagactcctattagatacatgatttgcagattttttctcccattctttgggtcccctcccctcccctcccctttctttcttttttttttttttgagacagagtctcactctgatgcccaggctggagtgtgcagtggtgtgatctcagctcactgcaacctctgcctccctggttcaagcacttctcctgcctcagcaggagaagtaatcccaagtagctgggattacaggcatgtgatgtgccacaacgcctggctaattttttttttttttaatttttagtagagacagagttttgctgtgtgggccaggctggtctcaaactcctgacctcaagtgatctgcctgcctcggcctcccaaagtgctgggattacaggtgtgagccaccatgctcagtctgggatgtcttttcactttcttaatagtgtcatttgaagcatgaaatattttaattttggtgaagtacagtatatttattttttcttttgttgcttgtgcttttggttacatcttagagtctgttaccaaatcctaggtcatgacatgtatccctatgctttcttttacaagttttatagtttttgctcttacagttaggtctttgattttgagtgaatttttgtatatgggttatgaggtaggggtccaacttaattcttttgcctgtggataaccagttgtcccagcatcatttgttgaagagactgttctttctaccattggatggtcttgataccttagtcaaaaatcacttctgaggatttatttcagtactctcaattctattctgttggtctctgtgtctttccttaggttagtaccacactgtctttgttactgttgctttgccataagttgaaatcaggctgtgtaagtcctcccactttttcttttcaaggttggtttggctgtttggggtcccttgcatttccatatgaattttaaaatcagcgtgtcagtttctacaaaaaaaaatgtcagctgggattctgatacgtactgtgatgaatctgtcatttaaaactttcaaggaggagtgtaacaggatcagaatgctattttaagaataggaacctgacaatactatataaaattagagcaagcttgtccagcctgtggactgcatgtagcccaagacagctttgaatgcagcccaacacaaattcataaattttcttaaaacattatgagatttttttgcaattattttaaaaagatcatcagctatcattagtgttagtgtattttatgtgtagaccgagacaattcttcttccagtgtggctcagggaagccaaaagattggacacccgtgaattagagtgatgaaggaaaaacactggatacttggagatcagataggaaactgctgtagtagtttaagaaaatgatagggaccaaactaggaaaagatagtgagggtggatttcagatgtattgaaaaggttgggctgggtgcagtggctcacactagtaatcttagtgctttgggaggctgaggtgggaggatcacttgaagccaggagcttgagaccaatctgggtaacaaaatgagaccccatatgtacaaaaaataaaaaataaaaatagctaggtgtggtggcacatgcctgtagtcctaactactcaggaggctgaggtgagaggattgcttgagcctaggagtttgaggctgcagtgagccatgatcacaccaatgcactccagactgggtgacaaaccaagaccctgtctgaaaaaaaaaaaaaaaaaagaaaagaaaaagaaaaggtctaagtgacaagacaggatttggggactgaatacatgtggggctgagaaaggtgggggatcaggggtaactctgaggtgtgaagagaggctaatggattagattatagtaccttttaaaactttgtattattttgaaatgacttttgacttacagaagagttgtaaagatattacagagaattcctgtatatccttcacccagcttcccctaatgttaacattttacataactatggtaaaattattaaaactgaaaaattagcatttatacaatgcaatatgaacttaactacagtctttatttgggttttaccagtttttttcacaaatgtcccttttctgttgcaggatctatttaggatccttaattgcatttagatatgatctctctttagtcttctctaatctgtggtagttccttagtctttgcctttcacaaccttgactattttgaagagtactgttcagtttactctgtagaatgcccctgatttgggtttatctgatgttttttcatgattccattgagattatacaatttgggcatccaataaggacgatgctatcaatagctcatacttattttattccctacagtgtgccaggcatttgaactaggtacctcaagcatttaaattttacagttaccctatgaaataatactattgtaatcctcacttgacagataagggaactgagcctaaagggttaagtattctctgtaggcagctggacaagggaagttgagtaatatgtcagaatgttgttattgcaaacatggaattaaaacaagtgaagttagaggaattgaaaatttaatatgatttgttgctgaattggctcatagtagggatgaattttctattgaaatcaggataattatagctattatgtattgagtgctagctatgtgctaggcattgtgccaaatgcttttcttgctttgtttcattttgtcctctcccaaaccttgtgagacatagatactatttttgtctctattttacagatgaaaattcctctaatctcttgcccaaggccagagtgctggtgagtggcagagccaccatgtggatccaagtttgtcttaactctaaagcctgtattctttaaccacttggcaatgctaactgtcctccttccatcttcttagtagggatgaatttgccaatgggactagaaaacatgatatttatgggcttggatgtagacactgcttggttgtggacattaccaaatacatgtttgcaactctccttattttatacctcagtggttggtcaaccccattctttctttgggtatatttcaagcaggttacaatctggtctttcaagtctgggattttaacgcttaactcttagtaggcactcttatttcccttttattcaaattcttgagggaagcttctttataaactccttagactgacaaaaatagtaaaatctcagaaataggcaaatcaagggagataatgaaatcaccagaatgggcgtttaaccgtggagtgtaagggaagctttcctggagaaaatagtttaattttgcatttgaagggtagataagagccacaagaggaaagttggaaaaaccatctggaagagggaataggattagcaaaggcacaatttcttgatgttagagatttaaatttaaaaaataaaattatgaaaatgttaagaaaacaataggtgactctgtaatcccactgttataaaagattttcaaagcgtgatatcaaagacagaagccataaagggaatgacaaatacatctgattacataaagatttaaaaagcttccataaataaaaacctatcataaacagagctgcaacaatgacagcctgggaaaattttttgcaataaatttcagtctatattagctgtcattaatatataaatagctctttacaactcagttgaaaagaacacaccagctgaaaaacagtcaaagtgcacagatggtcacatcccaaaagaagaaatatggctggccaatatacctgttagaaaatagtttaacatttctggtaatctgaggcatgcaaattgtgtgtgtgtgtgtgttttgcctgttaaacacgtgataattaccaaatgataatgacctgtttgtcaggttgcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagaggttcggtagagaaggtgggaacctggaaccagagaggttcgcaggtagaggatgaactgggataacagctgatgcctagattggatgcttaggaaagaactaaaggttagtacagggatctttcctgaggaagctgagagagtgtgtggttttgaatggaaccgtggattttttctgggaaaaccagccaaaaaagacctcagttttataaggattgcaagtgcccaccagacctggggatgaggcaggtgggagctataatgaacctgtctttgggactctgaaactcatctatgtaaatgcaatttgctgtccagttgagtttgtgttttgagatgtctcacactgtagagagtagatcttatgagctggctgatggcacaggtgtggggctgttggggtgactccctgtgtgccatgtggtcaagggccagggctagagtctaaagaaaaggagctctcatgagccctggtatgtgtcaggtgtgaagtggaaagtgcattgaactgggagttaagggacctgggctctcatcagaaagcttgtcagaaccttttcccctcagtttcctcatctctgaaatggggtttaataacatggttctgcctgcctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccacaaaaaaataaaaataaaaataaaaaataaaaaaattagccagatatggtggtgcacacctgtagtcccagctacttgagaggctgaggtaggagaattgcttcagcccaggagttggagggtacagtgagctatgattgcaccactgcactccagcctggataacagagtgagactttctcaaaaaaaaaaaaaaaaaaaaaaaaagataccttctatgctgctatgctgatgatagaaataggcaagacagaaaagatgaaacgactaaagttagaaccatgactgatggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaacaggaaataaagagcccagcagattcttggataattgagaatggtgtaaatggctttctgatttacttaagtcattaaagtgttaggtaggggaaaaaggaccccatttgctgcttcaaatagctccctgaaatagccacttagtctcttgccttaggtgagtaactttcagctgcgtgagggataatggatcctgatttcatgtatttcttacttgaacagctcctaaaggaaaggggtatttaaccctgttttccttccttgattttccaaaatgagctcaattattcagtgtaatgttttaaaagtaacatttattggttctatttcattatgaaagtaacaattctcattatggaaaacacagggacacataaggaagaaacatcatccatcccaaatccaagcaccaagagataattttgcttattacctttcttttcttaagaagcagagatcatattgtatattgaggtgtttactgtatcttttctaaatttaacttggtttattgatacattcatataggtgtgtaaatcataaatatgattgctggatttttttttgtagtggtcctttcttttccctttttttcttcagctcctagttctacctttccacactatccctttgtattaccaaaacagtatgtatcttttcacattttactccatgtgcatagatatacacatgcatacacacatacacacacaagttttggaatgttttgttgttgttcattgtttgttttacagaaatagaatattatatatactttaatatatctttttcattctacaatatctcatagaaatctatcacagtctattgatgtagctcttattcttttataatgttgtaaaatattccatgaatgcacaataagttattcagccattcccctattaatgaacatttactttctttgcacatttctgccactacattcaatgcttaaatcaacatgattttgtatatacccttatatactgttgctttcagtttagatatagatgtaggtagaggtatataggtatatgggaatgtttaaatatatatttatgttaatagatatcgccatattgatttataaaaacaggctgttatgctacactttttgcttttgtatgtaatatgtgagattattattttcttcttatccctatcagcaacaggtgttaatggttcttttgtaattttgacaacctaatggatgcagtttcttggctactagtgagtttcagtattatctcaattttttgtccaattaaatttgttcctcgagttgtctattcatattatctgcacattttcctatgggttgtttatatttttctaatttctaagacctctttgtatattttagattttagccctttgtctatcatcattgttacagatacctttcccaaatatgtttatattgacttttttttttttttttaattatttttttagtagagatggggtttcaccatgttggccaggctggtctcgaactactgacctcaagtcatctgcccgcctcggcctcccaaagtgctgggattacagatgtgagccactgcgcccagcctatactgactttgttgatggaatatatttccatataattgtttgcatttttatatccaaatatgactcttttcttatatagcatctgaatttcaagtcttggttaagatagttttcttgaagataggtagccagttgtattggaataatatattaaatgatccctattttaccctgtgatctctttgcagctattaaatgttttatatgctaggatctacttatggattctctattctgtttcttctttttgtctatttgtgtacccaaatctcatatatttgattacattaggctttaaaaaatatttttctggggccgggcacggtggctcacgcctgtaatcccagcactttgggaggctgaggcgggtggatcacttgaggtcaggagttcgagactagcctggctaacatagtgaaaccgcatctctactaaaaatacaaaaattagccaggcatggtggcacatgcctgtaatcccagctactcaggaagctgaggcaggagaatcacttgaacccaggaggcggatgttgcagtgagccaggactgtgccactgcactgcagcctggggaacagagtgagactctgtctcaaaaaaaacataaaaaaaattcttggctatttgttgtcacttgttcgtacacacaaattttaagatcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttctggttttgaactactcttacattattgaaatacacccgctgatcatagtatattattattttgatacattgctgggttctatttgtcaatattttatttagaatcttgcttcaatattcccgagattagagtcatgtttttcttagtgtttttttcttcaagtttaaggattgaggccaggtgtggtggctcatgcgtataatcccaacactttgggaggctgaggtagaaggattgcttgaggccaggaattcgggaccagcctggacaacataccaggactttgtctctacaaaaaaaaaaaaaaaaaaaaaaattaaaattaaaattagcagggcatggtgttgtgtgcctgtagtcccagctacttgagaggttgaggcaggaggatcacttgagcccaggagttcgaggctgcagtgaactatgattgtgctgctgaactccagcttgggctacagagcaagactccatcttttaaaaaaaacaagtttaaggattaaagttatggtggctatgtaaaatatactgcagaatgttccttctttttctcttgtctggaatactttaactaccgttagaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatccttagggatggttttgcacttactatcctgctactaacttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagtttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacacttgaaaagacatttcccattctaaggttagaatgggatttaaaacaatccagttttaaaatagttttaaaaatatttaacttgtcagtccatcaaaaattcattttgtgactagtatgaagtagagtatagcttatattttcccctagagagtcatttatttgagcaccattcatcaaataactattttcctatgattattgctattatacttttatcatacataaattcttctatatgctaggattttttcagcttgtattattcattgatctctctcttgggttttccatcagtttcatacccttatatatgcaacagctggtaaaccagatttcttttgctttctctgcagcctagcgcattacccacacttttttcttagctagtctcaaccattttttcgtccaaatgaacttagaatgtttctgtcaggttctcctcaaaatcctaccaggattttgattggaactactttaaacctaaaatttcattgacatcatcacaacacagagtctgtcatccaggaaaagacatgatatgttaatttattaattttcttttatgttccttagttgctcacatgcatgtgtgtgtatctcatatatttctcatcaagatcatccctggatagttgatagtttatgatatttattatattttcaaactagttattactggtaggtaggaaaatttttgattttgtgtgtctatgcttaattcttatttctaatagtttttcagttgcttctcttggattatttttgaaattaatcacaccagctcccatatgataactttatttccttttaaagaacaaaactgctgttttgctttcaaacctgattgtattggctagatcttttgggataatgttaaataatagcagtactagcaggagtccttgtcttgcttctgattttaatggaaatgtttctagtgattcacttaatagaaatgtttctaatggttcatattagttggctctgatgttgtctgttggtttaagttagatgttttttataatattagggaattaccttattcttaaattatcaagtcctcacaaaaatcaagaatagttggccaggtgtggtggctcacgcctgtaatcccagcacttcaggaggctgaggcagaaggatcacttgacatcaggagtttgagaccagcttggccaacatggtgaaatcccatctctactaaaaatactatatatatatagtatagtatatatatagtgtatatatatatagtatagtatatatatatagtgtatatatatatagtatagtatatatatatagtatatatatatatagtatagtatatatatatatagagagagagagagagagagagacatggtggtgcatgcctgtaatcccagctactcgagaggctgtgggaggagaatcgcttgaacccaggaggtggaggttgcagtgagccgagattgtgccactgcactcagcctggttgacaaagtcagatctgtctccaaaaataaagaatagttgttgagtttagctgatgttttctaggaatctattaagaggttcatttgtgttttctactttgatctccccatttggtatattatattatagatttcctaatatcaatctttgttagctttctaagataaattttccttttcctttgcatgcttgggagagcctcagatttggcttccatactattaatttgattgattttgctctctgctgtctccaatgtgaaatttatttatttttgttacaatgttaatttctctgtatttctttctagctctgttgagctacttaccctaggttgtctttccttctcaatgttttattctagtggctttctatacctgtttcatagagtccatgttttctttcattctattgaggatgtaaacagttttctaaaatatttcttctggtttatacacaaaattaagacgtttttgtttcctctgagttgtcagagtgatatgcattttccttgtgctgccagaggttttcatatgaactttttttttttttttggtaaagcaacagggtcttgctctgttgcccaggctggagtgcagtggcatgttcatagctcatggaatcctcaaactcctgggctcaagtgttcctctcacctctgactccaaaatagctgggactacaggaaaacaccaccatgcttggctaattaaaaaaaatatatatatatatatattaaaacagggttttgcggtgttgcccagtcttgaactcctggcctcaagtgatactcccaccttggcttcccagtgttaggaataaaggcatgagccaccatgcctggtcaggttttttgtatggtttatgaatattcaaaaaaggatctgtctttcatcaaatacagggtatgtagattgcctttgactatcctcaagctcagattctctctcatattggttagaacccttttcagctccattgttggcaggcaggttgatacacatagcttttaacctgtttcacagtgtctgtcagctactcatctagtgggttctgctggacccatatggaatcgtctacccctactacaatgttctcagatgctctgaaccagataaactatgtgaaacagtacagcctcccacatgtgttactacctgagtgttacttgtgagggctcccactcctagcacacagtgtgccagtaccaattctgccatttctgcccttttgattttggggaattagagtctccatgtgaatgtagaccagttttgagaattgctgatttcctctgcaagtagtaaccacgtagtccaaatggatgtccggtttgccagtttctagatgaactcttggcttctaagccatgaggctgacagttgtggaaggactcaatgtttcctatcttcttttaggtttctgtgggctgctgcatgaattggccagattgttttttctcatttcagtattaggcttattgttaatggagatttctcccagatcctggtaataagttggccatcagtttaagttttcagtgtttggggaattttatctttttctatatcttgataggtatttgagtgggaaattgagagaggctatgttagtgattgctagccaagtgctattttaaagtagaaatccagtgtatattttagattagagcagagattggcaaccatttcctgtaaagggccagagagtaaatattttagactttgcaagccatatgatctctgtgttttaactatttaactgttgttggagcatgaaagcatcacagaaaaatgcaaacaaattagtgtggttgtgttcaaataaaactttatttacataaacaggaggaccagatgaaaaagttctggagatagctggcagtcatggttacacaacagtgtgaatgtacttaatggcactgaactgtacacttaaaagcagttaagttggaaaaaattttatatatatatgtatatatgtgtatatatgtatatatgtgtatatatgtatatatgtgtatatatatgtatatatatatgtgtgtgtgtatatatgtgtgtgtgtgtgtatatatataaaatcatgccaataaagaagccaaaacagaaaaaccatattttgctgactctgagtttagaggaattagatctagcataggcagagagagagaggaagaaattacatatgtacagtaggacagtgactctgttaataagctagaaggcagtgggagacatttgagtatttaagaggaataccataatggggatggtgagatcttggaaagctacaattcatcctagtgatgtcatcttatgatctttacagatggagatacacaagagttcacattcacattctttgacataaggatcagagtagggcttttctacttctctagaggcttgagaaacctctgcagctgtcagaagtgttcatatcagaaacaaaagctaaccagtcatttctttttgcttgtagtacaaatggtgactagtgatgcttctggtagttgatctgagctcttcccaggactagaagatcctagcattttagttattaaccacagcacacttactcaataaaagagcagtcatcagtctgagtcaactgtttatacagcctccagcctaagattcttccttatcagctagagacctgggcttaagaatttcacaatgggctgggagcctcttagagaaactagccttttgagactttctctgagttgggctctcttgtttgttgttgttgtttttgaaactgtctcactctgttgcccaggctggagtgcagtggcgtgatcatggctcactgtagcctcgacctctgagttgggatatcttgaaggaatacatgaaggaaaagggaacagagattaaggttttccaggctttgggttgtaatcagacagtttagctgtattctgaacacccagcacttaatgtgcttggttatccatgtgtatgtatcaagggtgggggaactcatggagtgagtcactgagtggtatggtttaaatggcaggaaactcttccctcaccccgccttgggtaagaaaagggcatagcagagcgctgacacacatccctctgctccagaaagtgtacagtacccctctgctccccactgaaaccctaaagttgttcatcttcatgtgtgccaggaaaggagtggatctgtgatgcaaataggattatttggtcatatctgctgactcagtctaaagaagcttttgaaggggatgagatgaaatttcatctatgctgcagagagcaggaggtgcattgctggatggagagaggactgtaggctgcatgtgagccaaggtagacgagggaagcatgggggtgggcatgaggaactggggcagcctgacacgtgatcttggcattgcaaaactgatatcctgttggcctttgggccacatgatatgatgacagtgcagtatccccatggccctttctttttctagatttcatttatgatactctcagatttttaaatagcatgactttccccagggagaaattcagacctcaggtctctaggactgctctgaggtcatgagatagactcagtttgaacctgttgagtttaaatgtcttggaatgattttagcatctcagtaccccctttcccagtgctcatctggtcagctgctctggaacctgagggattctaaactgagacttagtttggggtcatatgcagttaaaaagggacagtcttttggcaccttcacctcggaggtggctgctttttggcttagcgttggactcatcactgaaaaagatagttgagaggttgtttttgacctgagcagccttattaagactcagttattggcaaaggagagaaggctctgcttataaatgttgcagatttaaaggggaaagaggaaaccacagtaagtaaagagcgattcagggagaccagtttctcttttttattcagaatgctgctcaggtatctgctttcctaggagccaccttattgtcaggttctgccttcggtttatgtgtattcttcccttaattcttagaagagggaagatgctttggggttgttcacaggttcccattcgacataaaatagaagctgcctacctttacatatactcagttttatcttctccaagtctcccagaagttctctttgaaagttcctagagcagggactgcttttattttttttccttctcctaggctttaagcatgtatttagatgtatgtcaccattgggtaaaagaaaggctaaagattcagataacttttcccatctgtggaaacatggaaagcagtactcagcagaggaatgaggactgattattttgggcctctttttactttatccaagtgaagaatctactgtgctatatatttgtcaaaagcaattccaaagggcaggggttgggggaaagcagtacggcataataagatttgggcaagttagataggagctgtgcagttggtaatgaagaagcagaactgtttctttctcattataaaagtaatccatgctaattgtaaggaaaagaaataaaatattatagaaagcaataaagaatacaataataataactgataattcctgttaatatgttggtataatttcttcttagttttctgtaggtatagatttcggctcactgcaacctctgccacccaggttcaagcgattctcctgcctcagcttcccgagtagctgagattacaggcactgccaccacacccggctaatttttgtatttttagtagagacagggtttcaccatattggtcaggctggtcttgaactcctgacctcatgatccacccacctcagcctcccaaagtgctgggattacaggcgtgagccaccatttttagaaacaaaataaagatcattctacatatgatactttgtaatatttaaaatataacgggattgtttacccatctaattaagtattcttaacatgatttctgatggctacatagtattccattgtttggatgaacataatataatgtatttaaacactgttctgttcaattcagcatttgatttatcgggtagacatgttttgaagggatcttgaatagtacagtggaattagagttatagttgcggttctgcttaattcttagctctgtgatcctgagcatagattaaagtcttagcttccatttcctcatttgtaaaagaatgctattaatagtaatgaccctcctgagtaaaaatggttagatgacatgacccatgtaaatttcttagcatgaaatctaacatataccaggaactcaataattgttagtagtagcgtatagcattatccttgtcttgacactttgtcatctgtgtactcactgttagaatttgggtctcaaggaaagaaaattgctttcatttagataagtaaaatttcagaatgaaaattgcctttagataggtagcctcttttaccagttgagtaccttccagataggggcatttgccaacttcctgaatttcacagggaaaaaaaaaattctgcagtctctgtggttgtgcggccccatttggttcagaacaaggaagtgggaaaccaccagctgcaaccagggaattatctttgtgtccgcaggcaaagccagccaagcccccctgttctacttatctttttttttttctttacttgcttgttttttatgttcttttagtctgaatttttttttttttgagcagagtcttgctctgttgcccaggctagagtgtagtggcacaatctcggctcactgcaacctctacctcctgggttccagcgattctcctacctcggcctcctgagtagctgggacttcaggcacatgccaccacactcggctaattttttgtatttatttatttttttagtagaggtggggtttcaccatattaaccaggatggtcttgatctcctgactttgtgatccgcctgtctcagcctctcaaaatgctgggattacaggcgtgagccactgcacctggcctggaaatttttaaacatacggaaaagtgaatagcgcagtacatagaatacttgtatagcttctgcttagtctcagcagttgtcctactttctttatttttattttttattatactttaagttctagggtacatgtgcacaacatgcaggtttgttacatatgtatacatgtgccatgttggtgtgctgcacccattaacttgtcatttacattaggtatatctcctaatgctatccctcccccagccccccaccccatgacaggcccggcgtgtgatgttccccttcctgtgtccaagtgttctcattgttcaattcccacctatgaatgagaacatgcagtatttggttttctgtccttgcgatagtttgtggagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatacacccagtaatgggatgactggctcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcactgtggttttgatttgcatttctctgatggccagggatgatgagcattttttcatgtgtcttttggctacataaatgtcttcttttgggaagtgtctgttcatatcctttgcccactttttgatggggctgtttgattttttcttgtaaatttgtttaagttctttgtagattctgcatattagccctttgtcagatgggtagattgtaaaaattttctcccattgtgtaggttgcctgttcattctgatgttggtttcttttgctgtgcagaaactctttagtttaattagatcccatttgtcaattttgtcttttgttgccattgcttttggtgtttcagtcatgaagtctttgcccatgcctatgtcctgaatgctattgcctaggttttcttctagggtttttatggtttcaggtctaacatttaagtctttaatccatcttgaattaatttttgcataaggtgtaaggaagggatccaatttcagctttctacatatggttagccagttttcccagcaccatttattaaataggtaatcctttccccatttcttgtttttgtcaggtttgtcagagatcagatggttgtagatgtgtggtgctatttctgagggctctgttctgttccattggtccatatctctgttttggtaccagtaccatgctgttttggttactgcagccttgtagtatagtttgaagtcagatagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatatcgatacttcctatccatgagcatggaatgttcttccatttgtttgtatcctcttttatttcattgagcagtggtttgtagttctccttgaagaggtccttcacatcccttgtaaggtggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctgatagtttgtatttctgtggaatctgtggtgatatcccctttatcattttttattgtgtatatttgattcttctctcttttcttctttattaggcttgatagtggtctatcaattttgttgatcttttcagaaaaccagctcctggattcattgatttttttgaagggtgttttgtgtctgtatctccttcagttctcctctgatcttagttatttcttgccttccgctagcttttgaatgtgtttgctcttgcttctctagttcttttaactgtgattttaggtgtcaattttagatctttcctgctttctcttgtgggcatttagtgctataaattttcctctatactcagctttaaatgtgtcccagagattctggtatgttatgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgttcagaagaatgtatattctgttgatttggggtggagagttctgtagatgtctattaagtccacttggtgcagagctgagtttaattcctggatatccttaactttctgtctcattgatctgtctaatgttgacagtggggagttaaagtctcctattattattgtgtgggagtctaagtctctttgtaggtctctaaggacttgctttatgaatctgggtgctcctgtagtgggtgcatatatatttagaatggttagctcttcttgttgaattgatcccttttccattacttaatggccttctttgtctcttgatctttgttggtttaaagtctgttttatcagagagtaggattgcaacccctgcttttgttttctatttgcttggtagatcttcctccatccctttattttgatcctgtgtctgtctctgcacatgagatgggtctcctgaatacagcacactgatgggtcttgactctttatccaatttgccagtctgtgtcttttaattggagcatttggcccatttacatttaaggtcaatatggttatgtgtgaatttgatcctgtcattatgatgttagctggttattttgcttattagttgatgcagtttcttcctagcatcaaaggtctttacaatttggtatgtttttgcagtggctggtaccggttgtttctttccatgtttagtgtttctttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccattctcttctggcttgtagagtttctgccgcaagatctgctgttagtctgattggcttccctttgtgggtaacccgacctttctctctggctgcccttaacattttttccttcatttcaactttggtgaatctgacaattatgtgtcttggatttgctcttcttgaggagtatctttgcggtgttctctgtatttcctgaatttgaatgttggcctgccttgctaggttggggaagttctcctggataatatgctgcagagtgttttccaacttggctccattctccccatcactttcaggtacaccaatcagacgtagatttggtcttttcacatagtcccatatttcttggaggctttgttcgtttctttttattcttttttctctaaacttctcttctcattgcatttcattcatttggtctttaatcactgataccctttcttccacttgattgaatcagctactgaagcttgtgcatgtgtcacctagttctcatgtcatggttttcagctccatcaggttatttaaggtcttctctacactgtttattctagttagccattcgtctaatcttttttcaaggtttttagcttctttgcgatgggttcgaacatcctctttagcttggagaagtttgttattaccgatcgtctgaagccttctgctctaaacttatcaaagtcattctccatccagctttgttccattgctagcgaggagctatgttcctttggaggagaagaggcgctctgatgtttggaattttcagcttttctgctctggtttctccccatctttgtggttttatctacctttggtctttgatgatgatgacgtacagatggggttttggtgttgatgtcctttctgtttgtcagttttccttctaacagtcaggaccctcagctgcaggtctgttggagtttgctggacgtccactccagaacccgtttgcctgggtatcaccagcggaggctgcagaacagcaaatattgcagaacagcagatgttcctgcctgatccttcctctggaagcttcctctcagaggggcacccggccgaatgaggtgtcagttggcccctactgagaggtgccacccagttaggctactcgggggtcagggacccacttgaggaggcagtctgtccgttctcagatctcaaactccatgctgggagaaccactactctctttaaagctgtcagacagggacgtttaagtctgcagaagtttctgctgccttttgttcagctatgccctgtccccagaggtggagtctacagaggcaggcaggcctccttcagctgcagtgggctccacccagttcgagcttcctgcctgctttatttacctactcaagccttagcaatggcagatgccccttccccagccttgctgccgccttgcagttctatctcagactgctttgctagcagtgagcaaggctctgtgggcatgggaccctccgaggccaggtgcgagatataatctcctggtgcgccgtttgctaagaccattggaaaagcgcagtattagggtgggagtgtcccaattttccatgtactgtctgtcacggcttcccttggctaggaaagggaattccccgaccccttgttcttcccgggtgaggtgatgccctgccctgcttcggctcatgcttcatgggctgcacccactgtccaacaatccccagtgagatgaacctggtacctcagttggaaatgcagaaatcagtggtcttctgcgttactcatgctgggagctgtagatgggagctgttcctattcagccatcttggacgggcaagtgtcctactttcttatatgtgaattctgaaacgcaaggtcctaactgcactccctgccacaagacagacaggattgcgctacagcacctcacaaagtgggaaaaaaatgtatacactcttagatccaggggtttatagaaacagaaagtcagtgcagaaggactctggactccgggatggtagaaatagattttattttttcagatggagtctcactttgtgcccaggctggagagcagtggcatgatcttggctcacttcagcctccgcctcctgagtagctgggattacagacgcatgccaccatgaccagctaatttttgtatttttagtagagatgggatttcatcatgttggccaggctggtctcgaactcctgacctcaaatgatctgcctgccttggcctcccaaagtgctgagattacaggcatgagccactatgcccagccagatcttttgtttttataatacaaatcacagaaagtaaatcttagtgtctggctgaaggaaagaagtagatccagatgtccatcaacatgacaatgggtaactaccttgtggtatattcataaaagtgaataatattcagcagtgaaaaacagatgaagtagagctacatgtataaacatggataattagaagttaagtgaaaaatgtaatttgcctaataatctttctctatacaatgtaccatttatttaagggtataaacatgaaacaacactatatgtgatttgtagatacatacaaacataataaatgtataaaaacgtgggcaacaaggaagtcaactactttagagtagaggttccccttgtagatggttgggtgagatgaatcgtattcaggaagggtacatagaggacaactgaatcaataatattcaaatttattaaagctgtatggtaggtgcagaggtgctaatttttaaaatattttactgtatgtttaaaactttaagtgtaaagaaaaaactagggcagaaaaacgttgtttaaaatgctcagaatcctggatcacttattttgtgagtgtgaaagctgagactgggagagttcagtgttttgcttctcatatacatttttgaattttgttcaattatcatacagccaaattggcttttttgggaataaagttctatgaatcttaagacatgtatagattattataattactaccacagacagggtttagaactgctccatcacttctaaaaacttctcatactcttcctttagtgtgacacccagatttctaaaccctggcaaccactgaccagctctgcaatcactgtagttttgtcctttggagaatgtcatacaaatggaaccttacagtgtgtaacctttagagagtgggtttgtttacttagcataatgcctttgagattcatctgagttgatacatgtatcaattgtttattcctttttatttctgagtggttttccatggtctgtaggtaccacagtttgtttatccattcagccattgaagggtacctggactgcttccagattttgtctattatgaatagagttgctgtaaacattggtgtagagggttccatgtaaacataagttttcatcttagtagggagccaggagcagaattattgagttgtagggtgagtactagtgtttttaacttatgaaagttttttctttttctttttttattaaaaaaaacctttataagataccatcaaatagttttccaaatcagtgcttttacatttacattcctaccaacagtgtatgaaaattccggtttctgcacattgctattgtcttttttgttgttgttgttattatagcaattcagatgagaagtggcatcttattatcgttttagtttgcatttctctaatggtagggaacatttttatctgcttatttgccgtgaaaacaacaacatattcaataacaacttcttttggtgaagtgtctgttcacagttttttcagccctttttttttcttctttttttttttttgagagggagtctcactctgccacccaggcgtgatcttggctcactgcaggctccgcctcctgggttcacgccattctgctgtctcagcctttcacgtagctgggactacaaggcacccgccaccacacccggctaatttttttttttttttttttttgtatttttagtagagacggggtttcatcatgttagccaggatggtctcgatctcctgaccttgtgatctgcccaccttggcctcccaaagtgctgggattacaggcgtgagccaccgctcctggctgagttgtgtgttttcttattgttgaatttcaggattctttatatattctggataaaagttctttgttggatatgtgatttgcaaatattttatcccatgttatatgttatatagcttatcttttcattgtcttaaagtgtctttcacagatcaaaagtttttcattttgattaatgtcagtttatcattttttttttcttttatgtattgtgtttttggtgtcatgtctaagaactgtttgcttaactgaagatcacagattttttcatatatttccttctaagacttatagttttatattttctatttagatttatgacttagcttttatataagttgtgaggtttaggttaagtttgttattttacatatgaatgtccaattgcttcaaccgcatttacactattttcaaaaatcaaatgattatatttgtgtgggtcaaattctggactattatgtttcattgattgatgtgtctattcttgggcaatactgcattgtttcggttgctttaactttgtagtaagccttaaaatcaggcaatgtgactccttcattatctgcttcttttacagaattattttagctattcctgtttctttgaccttccatatacactttagagtcagtctatctataaaatatcctgttgggattttgatcagaattgctttgactctatagatcgttttggtgagaaatgacatctttcctatgttgagcctttcagtccttggacaaggtatgtctttccatttatttaggtcttttattttatcagcattttgccattctcagcatatggatcctttaaatattttgttagatttatacttaagcatttcagttttttgaaacattttaagtggttctttcaaaaatgttgcttttcaattgtacactgctactgtgtagaagtgattgatttttgtgtgttgacttcgcatcctgtgacctttaaaaactaatgtattttttaggagcttttttgtagattccttgggattttccatacatataatcacgtccattgcaaataaggacagttttacttcttccttttcgatctctattatttttgttgcctgatttcctcgctaaagttgccagtctaatagtagtggtgagagtggacatccttgtcctgtttctaatgttgtcggggggagcatttagtctttcaccattaagtattagattaggcatagtaattttaggtgccctttatcaggctgaggaagttccctacatcaggttgaggaagttccctactattcctagtttgatgataatttttatcatgaatagatactgaattttgacaaaataccctttctgtatcagttgatatgatcacgtactttttagtcttttttagtcttttcagcactgatttggtgaattatattaattgaatttcaaatattgaactaaccttgtgttaccaggagaaaacgcacttggtcatagagtattattctttcttgtttttgagatggagtctcgctctgttgcccaggctggagtgcagtggcacaatctcggctcactgcaagctctgcctcctgggttcacaccattcccctgcctcagcctccggagtagctgggactacaggcgcccaccacctcgcctggctaatttttgtattttttttttatttttatttttttagtagagacggggtttcaccttgttagccaggatggtctcgatctcctgacctcgtgatccgcccacctcagcctcccaaagtgttgggattacaggtgtgagccaccgtgcctggccaagtattattctttctatactgctactttagatttgctaatattttactgaggatttttgtgtctgttgttcatgaggaatattggtctgtctgtccttccttccttccttccttttcttcctgcttccttcttcttccctcatcttcttctttttcctctattttcttcttctcttcctctccttcctccccactacccaactcctctagttttggtatctgggtaatgtagtgatggaccattctgtttaattgattgatgtgttcattctttcccctcttcaactcaacatgagaaatgtttccttctcttttattttctgaacaagattgtataaatatttggtagaattggtcactgaaactgagtctggagatttcttattcagatgattttaactatgaattcaatttatttaatagtattattcaggttgtctttttcatcttgggtgagttttggagtttgtggtttttgaagaatatgtccatttcatctaagtggtcaaatttatgtgcatagagttggttggagtattcttttataattttaattgctagggttctaatatcttctttcattgctgatattgttaacttttttccttctctctttttatccatgtcattctacctagaagtttataaattgtattgacttttttcaaagacaaacttttggttttattgatttttttttttttttttgagacagtgtctcactctgtcgcccaagctgaagtgcagtggcatgctcatggctcactgcagcctcgacctcctgggctcaagtgattctcccacctcagccttccaagtagctgggactacatgtttgcaccactacatccagctaattttttaaattttttttgtagagacaaggtttcaccatgttgcccgggctggtcttgaactcctgggctcaggtgatctccccgccttggcctcccaaagtgctgggattacaggcgcgaggcactgagccctgcctctctattgtttttcttttccatttcattgatctctgctctttattatttcattttttctgcttgccttgggtttattttgctcttattttttttattcttaaggtggaagcttagattgctaatttgagaccattctttttgcctaatataagaatttccagctgggtgcagtggctcatgcctgtaatcctagcactttgggaggccgaggtgggtggattgcttgaggccaggagatcaagaccagcctggccaacatggtgaaaccccgtctctacaaaaaatacaaaaaaaaaaaaaaccaacacaccaaaaactgggcatagtggcaggcacctataatctcctacttgggaggctgaggcaggagaatcacttgaacctgggaggcggacgttgtagtgagcccacatccggccactgcactcccgtcctccagcctgggtgacagagtgagactgtgttaaaaaaatttttttcctgttactagcatatttttgttgttgttgttcagttcaaaatattttataatttcctttgagaattcctatctatgaatttgcctttccagccatccagagaatttgtcatctgttccatatctttttgttcttggttgttatcaagtactaaattaaaatagaattcatctcgtgaaggatcataatagcttcatttgttatgaataatgtgatattcatttacattgatctgttaaggataatacagccactgtatattgagtgcttattatattctaggcactacattgatcactttacatggtcttattttattaaattctctaaccctttcagtaggtactcttattagttcaattaacaattgtgaggcaattgacacatattttaagtgatttgtctgtagtcacttggccagtaaatggtagggatgggatggaatgtagacttgattccaaacccccttaaccattttactacatttcctctagttatttcacttcttgccttctcataaaaattgttagctttttgagggcagatactgtgtcctacttatacttatcttcttttccctacaatacctgcaacaatgttaggcacacagtaatggattgactaatgtttgtggaactaaattcaacaaaattaactgatctagaagagaatcaaaaccatggtgcttgccatattgcctcagattcttaccagctaagcagactcagtgtagcatcctatacaaaaccaaaaaagcttataggaaatatttgtgtcagtaataatggctatcttgtgttcttttgtgatgatcagtcagatgtggccacaagagtagacagaggagagggtaaggaaaaaacaaagtttattatattcactggtcccagagacaagaggctcaggatactaggcaaggccacttgggaaagacattagggtggtcaggaggcaggagataggagcaaggaggaagttttagtccactgcctttattggggtttccacagaaaaagcagggcagggcaggacagggtgaatagttaaggattggctagtttgaatagtttcagcaggcctctaagctgtagggctgcaccctagttgtctggtgtctggccctggggcaattaaggaagaggaatatagcctcctggggtataaggggcagatagaggaggtctggctttggattggttagtttgcatatcaaaggcatgtttctgggtgagtacttgctgtctctaagaattggctggaggatgggggtcggggtgggggcaggctgtctctagccagaaaggtttttaaagataccaaaatatcacaatatacagaaaataaaatatatgctgcatatcaagcaattcaactttttcttgtaatatcatgacttttctttgcttcttgggagcacttccagcatgactggtggcacttcatctggatcccctggtgttattcaggggttacagtatcacactaaacaggatggaaaacatgagggaagggtcgacccttgaacaacatgggtttgagctatgcaggtccacttagaagcagattttttcaataaatatattggaaaaaggtttgggggtttttgacaatttgaaaaaatttgcaggcaagtcttatagcctagaagtattgaaaaagattaagaaaaggttaagtatgtcatgaatgaataaatacatgtagacactagtgtattttatagtttactactctaaaatatacacaatctattacaaaaagttaaaatttatcaaagcttatgtacacaaacacttatagactgtacattgtgccatcgtaattgagagatgtaaagatataaagatgcactattaaaacataactgcataaaattagctgtagtacatactgtactcctgtaataattttatagctgcctcttgcagtgagctcaggtgttgtgagtatcccttagaatgccctgtgcccctgatcatctccgaatgggctgttctttctccagtaaatggttgatcccaataaaaaagtgatccttgtggttctcgcatttttcatggtgtttagtgcaataccataaatgttgaataacaccagaggacccatacaaagtgcactagtcatgctgaagtgctcccaagaatcagagaaaagttaagacattacaaggaaaagttgaattgcttgatatgcaccatagattgaggactgcagctgcagttacccactattttagacgacgattcatcttgtgaacagatgatgcaaacttatggtattgataaatgtagtacagtactctaaatgtattttctcttcctcatgactttcttaatattttctcttctctgtaagaatacaatatataatacatataacatacaaaatttgtgttaattgatctcagtaaggcttctggtcaacagtaagctattggtagttaactttagaggagttaaaagttataggcagattttagactgctcagggagtcagtgcccctaacctccacattgttcaaagatcagctgtatatacaatacaaagaccaatactctgagctggtaaggaggtttataagtatgactaaccaaatataagtctgccccaagctctgctttttggttctggccttcagtctgtccatctgctttctctggacctccttctcatactttgaattttttaagtagtttgtccctcatatgattttttttctattcctttttcccttcctgtccttccttcactcctttccctcccacctccctccctcccttcctctctcccttccttccttccttccatccaaccatccatccatccatccatccatccatccatccatccatccatctatccatcttgaggctttaggtgagttcttcaccatttatttaacaaatgttttatatgagtcttactatatgccatgcacattttaatgcattttttaaatataattcccataacaatcctatgaattgggtactattatggttcctattgtacagatgagggaactccctcacaggactttctagtggccctatagccatttgccacacccattacaaatttttgtggcaggctggaggggggtataaagttaaaacaaaggcctctgcttctgagttggtcagtcatttacctgtagagctgtgctttgtcggtaaagggcaatgtagttgtgtgatcaggatagttgccacagaacacacaaggggtttaggcatgaccttccttgccccattggcacgcaagaactttttccttcctggcctgcagtctgatacatacacacatagaaacacagacacacacacacacacacacacacacacacacacacacacagacacacacacagagagagagagagagaatgagagagagagagagagagagagagagagagagagagagagagaacatatgtaacattcatgccatggatttaaagcagagtacaatggcaaaaatacaatcttgaaacttggcgacatctgagcgtgacttcagcctctgccacttattgtctgtttgatcttgggcagatcacttaatcacttggagctttggttttctccactatgaaatgaggaagatgatggtggttataataaaaactctgatgactgaatgagatgatatatttgaatccttagcccagtgatttgcacatagaaatgttcaatacatgttagaaatgtttgtgattattaatatgcaaggcttctttatgtattaaagataattcaccctctagcatatatatagcttgtataaactgaattttgagaacccagagcaatgcttgtctttatctagggacttaactgttttggatcttgatgttagttttatcttcatctttggccgtccgtaggtcctgatcagttccatcaacctcaagatttaacttttggtgtccaaatgtctaattggccctgtgcaaatgctgacatttcttttgaggtccatggcaaagcctggcaccagaatccagcttttttttttttttttttgagatgcagtcttgctttgtcactcaggccggagtgcaatggcatgatcttggctcactgcaacctctgcctcccaggttcaagtgattctcctgcctcagcctcctgagtagctgggactacagacgcctgccaccatgcccagctaatttttgtatttttagtagagacggggtttcgccatgttggccaggctggtcttggactcctgacctcaagtgatcctcccgcctcagcctcccaaagtgctgggattacaggtgtgagtcaccacgcccagcccagaatccagctttcatctggactgttgatgtgatttttttttccctctcccagagtgagtctttatgttgtggctgtcacataggagggcccaggggcagggttaagccagattctacttcactgaaggcctggaatggctgttaatagctcctgctatagacagtgaggcttgagccagattttttagtactccatttgtcagacacggggtgccaccttgaatgacactgctgaaaaaggattgtggtaacctggccagccccagggaggttggagtgacattgcgttggtgtgcctcttcccttttatggaccaggccaagccctattaacctgaaggagtgtgatggccttgtttagccaaacagccttttccactttagtcatcctttgaaatcttattaagccaggggcagggaaggaagaaggaggcagacagactcttgaaactaaaaggagggaaagaggaacattctaaccttccacctgaggtcatactttggcaggaggaagggaccagggaattttatacaaggcagcaagagagatataagagtttggggtctggagtcagataaacctggttttgaattctgactctactctcttatgtgtggtgttgaccagatcacctcacttctctgaaactcgtttccttatcaacaaaatgggaaaagtaattgtacctatctcagaagattggtataaaaattaagcaagaaagttcatgtaaagcagttaatcagatacttgcctggaatattattatttttcttctggttcttgattaaggatgcctggaatatattaagtgcataccatcgctattcgcaaagttttggtgacaaagaacaataggaagaaacagcctaggggaagtgaaaagcagtcttggggtttctgtgccattctccggggtctccttgtaacatctttcagtctgtctcccttcccttcttccctttttcccttcttccctcccctcccctcccctcccttcccctccccaagtcttgctctgtcgcccaggctgtagtacagtagcatgatctcggttcactgcaacctccgcctcctgagttcaagcgattcttgtgcctcagcctcccgagtagccgaggttacaggcgcctgccaccatgcctggctaatttttgtatttttagtagagacggggttttgccatattgtctagggtggtcttgaactcccgacctcaggtgatctgccagcctctgcctcccaaagtgctgggattataggcatgagccaccgcacccagccacatctcttagcgttacaaacacatctgtgagtgccaagagaagaggtaaagttctagagagtcttcaacatgtggactgttttcccagccagggcataggaggtatgctgtgtgtgtgtgtgtgtgtgtgtgtgtgtgtgtgtgtgtgtgtgtgtgtgtgtgtgtgattgagattgacatcaacccccatctagtgttgaggtctaagaggcgtgttgcctcggtggtggttgtccatgacccatcaaatcaacgtttcttcaagaggaacagactgtcattcttttcatctctcttagtagtaaagaaccatttgcctttaataatgaaggaagctacttaaatccatccccagagccctcacaagcagggtttgttcctgagttaattgtgcttgacttatgaagggtttctaatgagtatgtattttaacaagtctggcattgggattgggaaacagtatcattaaccagtgctggagaccagtggttttcttcttcttttttctttttgttttgcttttaagtcacagagcccaatatgtaaatgaaagcctggaaggctgcccacttttgctcctgagggcatttctaagaaagtggggaaatatagtttgcaaaacactgcagttggcttcctgggttgtagcaatctttttctgtttaggtctctgtttggggaaaaggattatacatgacagtgtaaataagcagccatgttataataaataggtttctactgtaataacagaacacttacctcccgcagttccccttttctaatgccgcccaagctgtagcagttgaagccgttgattgggactgactgaatgtttagggaacacagagctcattatttaataaagtgttgtaaccaaagtatgttcaggaagtgttcaggggattctgagccagtgatggtgctcttcagaacatttcagttaatacaaaatatgccactattaattcattttgtgcaaactccagtgccattttccacagagagcaacttgtatacatagttctcttccatatgccgtggcttaacctgatgtgtcttttttctccctttgtatcagggtctgagtatgacctgaactttatctttctccccctctaggctacagatgcacatgttgaatggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctcaaaacaataaaaaaataaaataaccagggcagaccaaagcctatacaaactcttggagaggtttaatggaaagaaagcagctttcaggtgttctaaggggctctcgttagattcaaccacattggccttgaataatttgctgtgggagcctcataacctgtccacttctccaaggacttcctagggcaagaattagattccttccccatccacccaaacccatgggccagtctggaccaaacagcccctcatggctagcagggagaatcccatggttgcagcgggctgggtgataaaccagcccagaaagaagcaggagctacgagccatgtcctcagactcccaaatgtgagactgtggaggcattagcaggtcacattgagaagctcagaaaaagaaatcacttataaaattattactactgctttctgacttaaatttgccttaaacattaagatcatagtttaaatctttaattgataatcatttttggatagcattttacagtgtacaaggtttttcgcataacagtgtttgaggtagacagggcaagaattatggcctcttgttttacagaggaagaaaattttactcagggagtaaaattccaagtggcagttaggattggagcctaagcctcttgatcctaagatcacagctatgctttgctccctctccacaaatattcctgtcatctcctccccacaaatattcatgtatacctttatgatagttacaattttcaagatgcatgtcatatatcagtagaaattatagagaaaacattcatctaaagcagcgattttgaaccctagtatgttccaggctcacctaattagcttgatttaatcatttcacaatgcaaacatacatcaaaacatcatactgtacgtaccttataagtacccacaattatttgtcagttaaaaataaaattaaaaacaaacactgatgcgctgccccacccttggagaggatgagttcatgatctgtgataaagcctgagcattgtgttttaaaaagttccccaggtgattctagcatggagtgggagttgagaaccactgatttcatgcaatgattctgaaacgtaatgttcatagcaatcaactgaagggcttgttaaacatgaggcttgtcaggccccatccccagagggtctgattgagagagtctacaagtaatggcagggactgaatgtttgtaacaagtccccaagtgatgccaatgcaggggtccttagaccattcttggagaatcactgtcccaggtgttcgtaactcacagttactccaagtgtgtaactcaaagtgtggtcctaggatcagcatcacatgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacatatctccctgggtctgctgaagtatccttagtccctttatcaataacagtagcggttgctgggtgcagtggctcacacctgtggtcccagctactcaggaggctgaggtgggagtatcacttgaggccaggagtttgagaccaacctgagcaacacagtgagaactcatttctaataaaaaatttaaaaatcagctgagcctggtggctcacacctgtaatcccagcactttgggaggtggaggcaagcagatcatgaggtcaggagattgagggcagcatgatgaaaccccgtgtgtactaaaaatacaaaaattagctgggcgtggtggcatatgcctgtaatcccagctacttgggaggctgaggcaggagaatcacttgaacccaggaggtggagattgcagtgagccgagatcacgccactgcactccagcatggcaacaaagtgagactccgcctccaaataaataaacaaataaatagaaattaactgggcatggtggtgcaagcctgtagtccaggctgcttgagacttccgccctcccttctgaggtgggaggattgctttatcctaggagttcaaggctgtagtgatttatgatcatgccattgcacaccagcctaggcaacagagtgagactccatctctaaaaaaataaaaagtaacagtagcagcactatcagctgctgattcttgagtgcttactatgtgccactgttctaagtgctttacatggcttagatttatttaatcgttgcaataaacttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttggggccctcagtgaatttccatgtgttctactctgccctgtgacttactggcaccaggatttgcaaatcagctagagaatgcctaggcttcagtttctctgggttctccatctttaaagctgaaccctaaaagaaggactgtgtattccagtggcccatattacaagtaagtgctctttacacctaggatcctggaaaaaggtctttttctagattcagatgaattatattaaagggcaatttccagtgatatgcccttttgtttcttggagtgaaggaggggaagtacatgatgaacctattgattattagattagcagggagctcaaagcttgtctgatgtcatcttatcttccagagggtaaatttaggaggataaatgacgagtttcagtagtcaaggtgggtgtccccagaacccatatctcttgactgagacttcagaattatttttctattccatgaatgaaattcagggagagtttgtgtgctggtgatagagtctcttccttgataaatgcacaaacacacaattttgcagacaatttcaggagggacacagactacaacttcctctcctagcccctctcccctctgtaagcccacctattcatcccatgttaatgtcttcctgcctaggctacaaatagttcatagtttagggaatagatgtgctgtctagtgtgtgagttccttgttatagccgctggccatttgtcctgatggtgatactgggttccttatctatacccgtgactttgcaaagaatatcatccaatccaggataaaccactttcaggaaattaaagccaaggagtggaagctaagtagggtgtccatggaacctggttacagattagattttcagttacagtactcacgtgcaaagctagtgatctggccctgaaatgagacactgggcccatgctgcaacttcagcgctctgcttttcaccctctaacccccatgagagtttcttctgaatgcagaatgttgttagcaagggagactggatacagaaaagaaagtgaagatactatatcagccctcttcccagaccaaaaactctagcctggcctgcatttgtgtttgtacccatctgtcttctactaggagaagcatgataattattcttttcatcaagctcctttcttcttcaaggcctaaagcctcaagtacattattatcttattatcaaacttgcccattattatatatccatgttgatctattatgttagttcctttttaccccctttactaccactctccttttgcccagttctttctgctctgttggatgggatggttcttttgagtattcctaactttcagactgagtggaagaagatagtaatgattctgtcattactggggtgtctagcctccattcacaaacactatattgatgttcttgggatgcagcttttccactgacacaccttgtacccatgtgtgctgctggaaaaaccttgttgtcaccaatgcagataggcttgaaaatctcactctttgctaattggcacatcgaaatgtgctagttgacctagaaaagttatttctgtgactggcaaattgggctattttaaaaagttatagtttggattttggacctgaactgaggacagaatgtccctttattatcctgagggttcttaaagcgtacaaagcttggtttcaaaagaggtattaattttctaaagaattgagtgaggcacaatagtgcctcaaccttctgcaaaggccagtatgtttctgatcagatgaatgcattgtgtctgaggatgtggggggtattgagatgagtttgggattcctggtccaaaccaaattctagggactatcctagaatatgtcaacttagtagctttattttaagactaagctttgagggtcttaaatccttgatgaatccagcctagatcacaccagtcaaaccacagatttttattgagcactttcctgtgttaagtatcatgccatgtgctgcagaagatacaaaaacaaccagtgtacattcctggtcctcaaagaacttgcagtttagttagaaagataaagtataaatgcctgaaaagttatggcaatattaaagttgaaaacatgaaaaaggaaaaatcatggttgggcatggtggctcatacctgtaatcccaacattttgggaggtcaaggcaggaggattgcttgagcccaggagtttgagaccagcctgagcaacatataagaccctgtctttacaaaaaataaaaaaatagctgggcgtggtggcacatgtttataatccaagctacttgagactcaaggctgaggtgggaagatggcttgagcccaggaggtcgaggcggtggtgagctatggccaacactactgcacttcagtctgggtgacagagcaagaccctgtcacaaataaaaaagtaaaacttacaaggcattcaggcttgactgctaaattgcagttgctctatgtttcaagaaatgggaaaaagattaatattagcattcactgagcccatactattttccaggtaatttacacatatattattcaattctcataagaaacccattttacatatgaggaaactgaggttcagatcagattaaacgacttgctcagagttacatcatttgtaagtgctaaagctaaacctgtgcactttgtaccttaatacacagcctcctggagtaagtggtctggaaaggcttcatgaagaaataaagcctgagccaagccttgagggatggttagaatgtgcatgcaaattgcataggaaggaggctgttcaagctaagggaacacatggacatggaggcagaaaatagtcaactaagtattgagattctgaagagcagggtgggagtcagggattccagttgtacacagagacattaccacttatttgcaaatcacaagaagacactgtttctgtcatgtctcttaacccttacagtatttagattttgtgtacatttcctatcttttcaacctccacaaataagaatttcttatgtgtggatgggactttggaatcagaatagctcttttacacatatctcaccctagtgtagttgttaaggggattggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacctcagttctctcatctataaaatgggggtgataatagtgcctatttcataaagctattgtgaggattaagttagttgatgtgtgtaaagcaaatagcattgcactgttagccattattagtctttgatcctcaccaaaaccctgtgaagtgtgtattagcatgtccattttacagacagagccttagaaagtttaagtaacttgtacaggggggcacacaggaagtgacagaactagcatgaaaactttggtctttctgataccaaaggtcatcataccaaaggaaggtttggtcttcttctctcctagttatttagattgatttttaagtattcagccatatgaccgccttttggcaaattttatacagtatcgattagcaatttgggggcttaattttacttttaggatttttttgttacagaaatagtagatgctcatgactacagtagcaataatatattgtatatttcaaagtagctagaagagaggacttgaaatgtttctaacacatagaaatgataaatactcaagggcatggataccccaaataccctgacttgatcattgcacattctatgcatgcaaaaaatactcatgtgcactccataaatctgtaaaatattatgtatcaataaaaggaaaaagatttttttaaaaatgagatatgtgaaatatagtgaattatttcagataagttctaggaagaaaaataatacatggtcattgaaaagtaactcagaggactataaagaaaaagctaatcattttaccagcttttagtcctgttgcctcaagggtaaattgtgttaaaagtatctttttacacttatcctttgcttgtacatggagattaaagattttcatatttctaggattgttggtttatttgggttccagcttcttacacacttggaattctacaaataccactccagtatatttctttctcttttttttgaagtctcagtctgccacccaggctggagtgcagtggtgtgattttggctcactgcaacctttgcctctcaggttcaagtgattctcctgcctcagcctcccaagtagctggggtcacaggcatgcgccaccacgcccggctaatttttgtatttttagcagaggcggggtctcaccatgttggccaagctggtcttgaattcctgacctcaaatgatccacctgccttggcctcccaaagtgctgtgattacaggcgtaagccaccatgcctggcccagtatatttctttgtttaacttaaacactagataatcagtaatctcttcaggcatggacataactcttttcatccatagtttggttggactatatattcatatattccttctattctctgtgggtaaggacagtgtcttttttctttcaagtgagcagtttaataggataaaaatattgcggaccactgacctacttcaaacccctcatgttacacaaaaaatagacacagagagatttgttccagggtccactgttagataatggtaagctgaagtacagacttagaattcccgtttgtttacttcaaatccaggactcttttctgctttgccattctcattattcccgagttctgaagaccatagtttccacagagtgcatgtgcaagtggattatcgctggacaccaaattccaaatgttcaagtacacatcatttcagtacacacacatgtggctagtgtcctttccaacctttgccaaagtaccacctcactttatgaggcaaaatgtgtaatggagtcaaagtccgaagaaccaagcagtagattgtagagcatggatagagatcaataataaatacttcaaagttcaaaaatggcgacatttgattcattgtgaattgacttgtagaaagccccattggagctgaggacaagtgtcttttgttttgtggctgcccctacatagccttgtacttagcacctggtagatatctatagatagaataaatgaattcatcagccaacctgaacctctatgttgcttagggaaattctggggatccctctcacatatgtcctgggatcttgggtgcaaagacagaggggtgatagataatatttttttccaggagaatttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacactcatttaaaaattttacatcattttatttttggcacctaataattgcacatattttggaggtacattgtgatatttagatacagacagtgtgcgaagatcaaatcaatcttgttagcatatctgtcacctcaagcatttatcatttctttgtgttgggaacattcaaatcctctcttctagctattggaaaatatacaatacattattgttaactatagccaccctacatggctataggacattataacttattccttcgatctagctataattttgtatctgttaaccaacctccctatctccaccctccccagcctctagtaaccaccattctactttccctttctatgacattaactttgttagctcccacatataagtgagaacatgtggtagttatctttctgcacatactcattttttaaaagcactccaggcaattccaatgtgtgcaaccagggcagctctgctgtacaccttgttctagttctgccctgccactggctggggcttggggctttgaaggatttaatttcaccatattaagtatcagtttccacatttttcaaatgggatttgtaaaatttaccctctctacctttcagacaagttataaagaaaagataccaaaagataacaatgaaaagataacaaagagctttggaaagttaaaagcactacacaaatgagcacttgccttgttctctctttgacttcagtcacaattttttgtaaagggggtttaattgacatataatttacaaatgaaaagtttatccttttcaaatatacaattcagtggtttttaatatattcacagagttgttcaattagcaccacagtctaattttagaacactttcatcaccccgaaaagaaattgcataaacattagcatcatccccattccttctttccttgttctggacccaggaaaccactaatctactttctgtctgtatggatttgcctattctggacatttcatgtaaatgtaaccatataatatggcattttgtgactgacttctttcactcagcagaatgttttcagggttcatccatgttgttgcatgtatcagtacttcattcctttttacggctgaataatattcctttgtattatatatcacattttgtttagccatttgtcggttagtgtacatttgggttggttctaccttttggctattgttaatatgctgctatgaacatttgtataaagctatctgtttgtctgctttggagtatgtacctagaagtagaattgctgggtcaaatgataactcagtgtttaaactttagagtaactgccagactattttccaaagtggctataccattttatatgtccaccagcaatgtatgagcattccaagttctcaacatcctcactaccacttgttattgtgtcttttttattatagccattctagagggtgtgatgtcgtagaggttgagtatccgttatccaaaatgcttagaactcgaagtgtttcagattttggaatgctgcactttgtacttaccagttgagcatccctagtctgaaaatctgaagtgcttgaatgagcattcttttgagcatctctttaatactcaaatttgacccagccatcccgttactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagctttaggagatatacctaatgctaaatgacgagttaatgggtgcagcacaccagcatggcacatgtatacatatgtaacctgcacattgtgcacatgtaccctaaaacttaaagtataataataataaaataaaataaaataaaaaaataaaatatctgataaaaaaagtttcatattcaggaacatttcagatttcggatttttgaatgctatttctctgataactaatgatgttgaacactttttcatgtacttactagctatttgtatgtctttttggagaaatatcttttcagatcctttcccaaattttaattgggttgttttcattgttcagttataattgttctttctggatattaaacccttatctgatatataatttgaagcattttctcccattctgtgggttgtcattgcatttgcttgattgtatcctttgaggcacaaaatattttaattttgataaagtctaatttctctatttttgatttggctgcttgtgcttttggtatcacatctaagaaactgttgtctagtccaagatcatgaagatatatgactgttttcttctaagagtttcatagtgttggctcttacatttaggtctatgatccattttgagttaatctttatgtgtagtgtgaggaaggggtccaaattcatttttttcatgtggatatccagttgtcccagcaccatttgttgaaaagactcttctatccatccccattgaaatatcttggtatcctttctaaaaatcaatgaaaaataaatgtgaaggtttatttttagaccctcagttctatctcatttctctatatgtctatccatatgccagcaccacactgtcttgattgctgtagctttgtagaaagctttgaaactgagtgtgcattgtaacaagatcttctggggattagtgtgtgtgtgtgtgaatgttgaaaagggctggaaagcaaagttgaaagaaagcaaaatgagcaatatagtgttcagatgataaggcccagggggattgactagcctgaggccacatagccagtgattggcagatcttggttcagcactcaggtcttctgacttccacatcagtgctctttccacctcccctgttgcataagtactgaatgagatgcctttggttaatggacactctgagcaagagacttcagggttatttaagcaactgaactttgctcaatcgcctcatctgtacaacagaaatattacctctatcactggctgggcctggtggctcacgcctataactgcaacactttgggaggctcaggaggaaggatcacttgagccgaagtgttgagaccagcctgggcaacaaagtgagaccctgtctgtacaaaaaataaaataattagccagccatggtggcatgtgcctgtagtcccagctagtcagaaggccgatgtgggagggtcacttgagcccaggaatttgagaccagactggccaacatagtgagaccggtctctaccaaaattttttttaaaaaattagccaggcgtggcggtatgtgtctgtagtctcacctacttgggaggctgaggcaggaggatcacttgagcctaacagttcaaggttaccatgagccatgatcatgccatacactccagcgtgggtgacagagtgagaacctgtaataacaaatggaaggaaggaaggaaggaaggaaggaaggaaggaaggaaggaaggaaggaaggaaggcaggaaggcaggcaggcaggcaggcaggcaggaaggcaggaaggcaggctggctggacggaaagagggaagcagggagggagggagaaaggtacatcatagttattatgaggattcaatgaaataatcctttgttgggtgccaactggcaagatgaattcagttttccattgcataaaaagaatcggggggtaggcagagctcctcctgaggcccatctcttacctcaacaggtggcctgccaacctccccttaggtcccacacgcctaggaccttgagtggagtgaactgagactttagggcaaactgagggtttctttagaaagtccaaggaaagagtgatcacttctgggtcccggtactgcatgggtgccagttgaggaagctttggtggtaggatccggccagaggagctaacgcaggaaaggagtttggggtggaaaaacttcgtaagctaggaggtcctatgatgtagtggataagaacaggagtgtatgtatataattttatattgtagaaaattgaaagcatacacaaaagtagaaaaaatgttccctaatgcatctgtcacccagtttcaatgattgtcaccacatagcccatctttttctttttaacaatacacctcactccaccacaaatccattccacccccaacacaaacacctatccctggattatttggaagaaaatctcatgtaattttaactgtaagtatttcattatgcatgtctgaaatgtaaggacacagtaaaaaataaacattacaataccattatcatacctataataactagcaataattccttaaaatcatcaaagatacctagtcagcagagcccaggcttttaatctagccaaatcactgttccagtcttccttctacagcatcaatagcctgtctcagagcctgttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagcatctcctgctctgggacagttacagactgttggctttagcagtgatttggagagtttgtgcttgctttggctgggaaagagacttatccatagcctactgcctttcaggattcttttctaaggggatatcaatgcctgctctccacgtctattttctcgaggcccacagtggagcacaaacaatggaaacataggaatccatgcagagggctttagcgatctcctgggacactgcttctgtcctgtcttttagcccttatagtttatagtttagattttacatgtgtttcctatcttttcaaccttttctaataagaattccttacatgtggatgggacttggcaaccagcaaatctcaccttagtgtagttgttgaggatgggttcagggattttctagaaaataaatctattttctaggtttatttcctggctgggccactcctgtgtgtgtgtgtgtgtgtgtgtgtgtgtgtgtgtgtgtgtgtgtgtgtgtgtggtgttggtgggaagaacataaggttcttcatggagtgggtgttcaatatatgactgattgaagagaaggtcaatttgtaggtcaactaggtggtgctgaaagaattgagcaactcccatttgtgccttatgccacatgcactgtacataactgtgtcttggtctccaaactaggccagaggtcaactgtaacttgggccaaaggtgccttctgtttccagttttgagcaagggaatggcagctctccatatggagcagggaccagggggtgctgttggcagatgcatggtgagagctgtcctgaggaagtaccatccagagtctcgtcctagcaaggtgttttagtgtggttaaagggtcactcctggccgggtgtggtggctcatgcctgtaatcccagcactttgagaggctgaggcgggcagatcacctgaggttggcagttcgagaccagcctgaccaacatggagaaaccccgtctgtactaaaaatacaaaaattagccgagtatggtggctcatgcctgtaatcccagctactcgggaggctgaggcaggagaatctcttgaacctgggaggcggaggttgtggtgagccaagatcgcaccattgcactccagcctgggcaacaagagcaaaactccgtctcaaacaaaacaaaacaaaacaaaacaaaacaaccacaactcaactcctgcttccaaagatggaagtgagagaagattctttttcctttaactgagtgggcccttagttgagatatacagacatgttttaatttcactaactcggccccacagtgtaggagggggaaaggaacagcaagtagtccaggtagaggaagagctagggtccccacactctagccagaattgggggagctccaccttctctgatcaggggagagacaggattcccatcacctccttccaataactaaaataaccacagcacaaatatgtgtcctgtatcagcaagctgccattgaaagagggccatggaccctgcgtatgatagagcatgctaggtgcactcatggtccttataaaagcagccaggtatgcatgggctgggccctgcatgcacaagttacccattggtccactaaacgtatgttcctaaaacccattatggtcttaagaattcagactggcatggatgcaaaaattcagataacccctaagtaataaaagtacttatttttctttagaacctaagacctataagtctcaactaatttgaagaatactctggtgaccaaagggagaatgcctcttcaaaagattgcttttatttggaggttgcaggccttgcatagggtcgttcccccagcccccggggactctgttaatgaaggggtttgggtagggcttgagcctctgctccttcaacatttcagcatacacacaaaagagcctacttctcagcacagatgtgactactatgtgtccacttggatgtcacatttcagggaaggttcattcataatacaggtaaaatgttactatattttatcctctgttgttgctttgaaaagtcagtggtcagcctttttactcctttgaaagtaatcttttcaggtcacttttgaggtttttttgtttctttttgtttggtgttctgcaattttgctatatgtttcagtattgatttgttctttcttattctgtttgggagcctttgggcttctggtgtgtgggtatatatcattcatcaggtttcagaacattctcagctgttataacttcaaactctgcctctgttccattctattcttctgggaccacattttagagatatgttagtccatcttactgtgtcttcttatctcttaatctttctttgatattttctaatttgtcttactgtattgcactttggctaatttcttcagctgtatattccagtttattatttatctctttagttagttctatccattgagtttttatttcagttattatatttttaatttttttcaaacatacaaaacagtctgtaggtaataattttattatctgcagtctttaaatttctgttttcaggattcctggcttgtttccttgtgtatttaagttttctttattttaaatattattatttttgttgctttactgtaagttgcttattttccttgggattttatttatgggtagtttttgactcctggtttcctgtagaaaggatctgtcttcattcttgctaggcacctgagagctgccagtctggaatcatgctaaatgaattctgacctcaggttttttgattacccaagtagtatacattcacttttcaaatacacatgatggctggcttgccgttccaagtttttattggagataacctagttcctttccctgctactccaactcagtgtaaagattgagagtagattttccttatcgtcctagggggcaggagtaatttgtatttctagtacacgtttacactgaagtgtagctttttggggtcccagctttatgagagttatctcctatcagactctttttgggatatcttgacctttgtcccccatcccttatgccctgtgaagctatgagaaatcaaagctcaagttcagctggcttagcaaatctactttgggtgaaaattggatgccgtatcccacttatgtctctgggttcccactttcactttttttctggctagaaaattccttgtgtatttgacagttcatagattgaaaaataaaacaattttaaaaatattttatccaggacttttggatgttttcagtggtagatttgtttaagaactagctttttatatgctcagaaatgaacatctggatcttgttttccaacacttttatggctgtgtccttactttcaggagcaaccaggaggacattctaattctattccttggttgtcagtgctctcctgaaatatctctaaataagttgataaatacctactgtgtgtctagtattgtgctaagttctatgaaatatcgggaagaccatgtagcttctcatgtagctaacagaacattggcagtagtggccttcagcccttggaacactgatttaaaccatattttcatttccaaacccttttaagccctagaaattagcatttagaatgatgtggttgtaagactgtaaggtacataaaggcagaggccatttgtatcttgtttataatagttggcacatagtagatgctcaataaatactgaatgaatgagtatctgggaggtcatggaggcagattccaatgctgatcagttcccatggcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacatgtaggtagtataagtcggtgattaagaacatggactctgaagtcagactgcccattttcatcctggctctgtaagttacgttgggtcagttacttaacctctttgtgtctcagttttcttaggttctacctatagagttgtaggaattagctactacatactaagtattaagacaatgcctggcagagaagtgccatgtactaacaattacttattatttctattattattatctccgttgttgttttgaacaccagtcacatcataaaaaatacattctcctgggagttatttgtcatttctatatgaaaatattctgagttttcatacttaccccttaggattttggagcctgccctactggagtatttctccaggtaggggttgaatacctctgtatctttttttttttttttagggaaatatattaaaatacaggatgctgggccccatcccagttggtccaaagaaatttctttctctgaaactctgtgatgaaaataaagattctacacattctctgtgtgttgggttagccaggaactgctgcaggtttaagtttaccatccttcagtgctgatggaaaatctgggagcaggcttggagcctgagaagaaatagagaattggagagttaaacagaagagaagagaagaaagaaagaaatagaaagaagtgaccagagtgtactcatgtcaggaggtggtcaaatcccatccatctctggtggcctccaggggatatgtgacatttgctttcccttgatttagggatttatgaacctggctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggtagtacctatattatggcagctaggtagcgtaagtccttccgttttcatagtagactttatttcttttccatcagggagcagcctgaagtatggaacagacaataatggttaagatgatgggttcttgagccaggttccctgggttcaaatgccggctgagccacttaataaacccaagaccataggcaaattatttcactgaaaccctatccctttttcttttaaaatggaccttggatacacataattggagtaatcatatttctaatccttgactcatttcatgctgcaccattcgtccatgtatagcctgctttaattttatttatgtgtgcatttacttttttatggataatatgacaactgtgagcccaacttaagaattagccacattgatgagaactcagtctgcctgtgtgctgctcccccaatcctgctctctacctccctctccaccctgaaggaatcgctggcctgaattttggttattattctttttctctttttgaagttttatctctctcatatgcacagagatatttatattcatattgatgtagctatggatatatagatatatacatgtagatatatcttcctaaataagatattacttggttgtttttctggccctcataaaaagggtattatgttttaggtagttttctggtacttgcttgttttactcatcattatattagtatgattcattcctgccacagagtataactgtagttacaatttcactgtggcataacatttcatgttaatataccacaatgtatttctccagtctccttgagatgggtttttggtcatttccagtattttactatcatgaaaaattcctctgttcctcagttttctcatcttcaaattggggaataaccataggagctaccacataagggtgttatgaagataaaaggagttaaagtgcttagaacaagaccttgctcatagcatattgttggtccgtgtattggtttgttagggctgctatgacaaatatcacagactgggtggcttaaaaaacagaaatttatttcctcacagttctggaggctagaattctaaactcaaggttttggcagggttggtttcttctgagggcctctcttttccactggtgagtggctatcttctcccaatgtctttgtagggttttttcctctgtgtctgtctgtgttgtaatctcttcttctttattgtttttttctttttagttggagtcttgctctgtcacccaggctggagtgtaatggcacgatcttagctcacagcaacctccacctcccaggttcaagcaattctcctgcctcagcctcccgagtagctgagattgcaggcacctgccaccacacctggctaatttttgtacttttagtagagacagggtttcaccatattggccagcctagtcttgaactcctgacctcaggtgatccacatgcctcagcctcccaaagtgctgggattacaggcatgagccaccgcgccctggactgtaatctcttcttatgaggacactggtcatattggattaggacccacccatatgacctcattttaccctaattaccttttttaaaggcactatctccaaatacattcacatactgaggtattgagggtgaggaattcaatgcatgaatttggggagagacacaattcaggccataagagtcagtaagtattcattatgaccatcattctcttcaccctcctccttatcattaaagctcaagaaaatgcagcagacttagttatgatatatcccctaggaacactattatgtgaactattattattatccttaggcagaccaaacaccagagcttccttcccggccttttcagaaatgactttggatacttggataccagcaacaagtactcaaaaatggtaaattgtggtttcttaagatgataggcagcagctccttaagtcagttagatgtgggaggaggagagtgaggaggtttcatttccatcttggttaaaagaaacagctaagtgagctcttgtagagtatctaatggtatacagactcgaaattgccacttggtaaagttctatgggttttcctgaaagaggcaggcagatctggtttttcaaaccaggaaatacacttgcacaagtggctgtgccaccagaacaaacagcatcttttatgggctcaaagtatttgacattagggagctggctaggggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaaaaaaaaaaaaaaaaaaaaaaaaaggaccagtggctgcccccccgcttaattatgcccccctgccctttccatgtcagacgatgaaaattagatggaatagcatgtgcctggcagggctgtgggcatctgtccttactggaggtgaggtgaggagtgggagtagggtctcgagggaaaaatacaatgagaacaagggatttgggggtctatggatgccccctttacacattattttcttaacaggctgtgattctccaaaggagggaattcttaaaaactagaacaaattaacactaatcatcattaataatttaatgcatcctcttggataaggattcctgtaatgtagagatgtaaagaatgtaacataaaagttcccacctcctactccccagagagaattgctgttaacagtttggtgtacttatcttttaacttttttcatcctttaaaagaatttagctacatgattaaaaatgaatacattcatttgttataaaaaatatatatatacaagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaaaaaaatcaggatccagtgaagtttcaagtattgcttttgattattccatctctttactggttttcatttttttaacctaagaacggtacccccttcttcatttatgatactgaaatttagggagttattttgtagaatgtcccacattctggatttgaatgtttccttaatgacaccttcttatttttaatggcaatgtggtattctgtaccatgaattcatcgtggtttttttaactagtcccctattgatggtcatttaggtcgtggcattccttttgtggctcctctcacaagtggtatttcgtcctaaggagtttgtggccccagtaggccacagttaaagtctgtggtcagttaatgaagataaagtgttccaaaacctaacttcgctggcaggaacattatcaagggcagttgtaaactgtgaattgcatcctttcccctctaaaggagatggattatcttttttgattccctgatttattttgagaggctgtagtctagggctgagctgagaccagggttctgtctttgtaactacctattctcacttggcacctgatcattaaccatggactcttctggtaaggccaagtcacctgaggtatggtgtgagctcccttaatttgcagtgtgcagccctccctcaagcagttattctcacttcagcctgttcttccttcctcatctcctgggatcccaaagctaatatttccatctgtgctttgggtcctattccctcccacctgcttccagtcctctcgctgtctagtgcctcctgccccttatgcttctccagcatctccctgtccactggctccttccttcagtctatacagaatctctcctgttcttaacagttatttctcaatattgataccaccctttagttatagttttcatctctctccaggcatttactcttctcaaaagattactgaggaccaggggtccaccaaatggggtgcaagagatgttccattgggtgtgtgaagaaaatgttagatttctattctaataaaatttcatccttttaaatttccatgtttgtgtgtcctgatgtacatttaggtgtgcatattttataatttacagttatacatgtatatcatttgccttactttcgattcttatcatcctctctagcccccttcagatccacacccacctacattctcaccgatttatgagcttctctcccaggcagtcacactggcatcacaaattcagcatggccccagcttcttttcttgtacctcacctcctccaatctgcaccctagactgtaggtcccaacatagggagaagccccaacatcccaccatccatctaagccatagcctgtgagtcatcttcaacttcttatcttctcttacttctgcacaataccctgtccagtcaattaattagtcctggcaattcaacttccttaccttctctcaaatctgcccatcctctcttctctcgctgtgtctgcctttgtttaggcattgctatcgccagcccctaactggtccctctgcctcaagtagcaaaccctgcacacaaccaccaaaaggagctctgcaaaactacataccatgcatgcctctcactcacttagaaaattcaaaccaaagccaatacatgatctacagggcctcccatgatcttttcctgcactgatattcttgccttatctgttagcctcctcaactagactatgaactgttgtagggcaggggtccctaccctgcaagatgtcttcattattgccacatagcaagaggcaagcacattacctgtcacctaggcgtgccttaataggtgtttttggtcaacagtatgaaagtgagaataggactgttttgggtaagaacaggagagtggagttgaccttcctttgagaaataaagaagtttccagtgagaaactctggcctatagataggccaaatgaatggactgatgtggggagctaaagttaccctggtagtcatctgataaacatactaatgtgtgacttaggactgtgggacaggcccaggtgataccatctcttcttgctaaggcagaatgatgaaatgaaaccccagcttttgacctagaaagatgtggcattaagtcttactgcctgggatggaaattctggctttcctggttactggctggattgatgttgaaaagggggatagtgattataacagccagcatttaatgagtacttactatatgccagcactgggccaaggattctacaggtattatttcaccacaactggatgaagtagatactgttattcccatttatgaataagtcaactgaggctcagcaaaattaaatgatttgcccaaagttgtatagagaataaatgatggagacagaatttcaatctcagcagcctgactccaggctggagataccgattgggagtcatcagtatacagatggtatctagagccaggaacctggataagattacctagtgagtgggagtagctatagaagaggaacatggaattggttcttggcccctgtagtatttagagatgagggacataggggaaattcagcaaaggagattgagaaggaacgccattgaggtagagaaagaacagagggtgatgtgcgagaatcccagcacagaaagtctattcaggatgagggaatgatcaactgcatcaaatactgttgatggaccaagtaagatgagacctgaaaatagaccaggactagtatttctagttgtgcaggttgttaattgcataatggagtgagtggtatctagaatctctctgacaccctggcatggggttgagccttggcagaagaaggagagcctatttcacataaagacgccatgtgggctaacttccatccttgtgttgcctactggaattagaaacatggaggtcattggtaacctcaacaaaagcaatttgagtgaaatggtaggaatgaaaatgtgattgaattggatggaagaatacttcagaggaaaggcagtgatggcgatgagtagagacatctctggaggagttttgctgtaaagtataaaggaaagcagagaaatagaggtggaagctccattactaccacaaatggaagtgaggtcaagagcttttgtttctttagatgaaaggtattttagcatgtttgttttctgatagcaatgatccagtgagaaaaacagacaattgctggtatgacattcttgagtaggtgagaaaggataggatctagtacaggagtgatggtactagccttagccagcagcacaggtgcttcctgcatagtagcagaggaaaaagcagctgtggggatgggtgcagggaggagggaggtatggaggtgggagcttatgcatgttatcttctaatggctctccatgccccctcacctcactgaaataggaaaccatttcctcagctgagagcgaggatggggaaggtctgaggaaagcaggagaagttgtgaaatagtggcctgggagagaggagagtaaatggtcttgggaatatagtgagattgtagagcagcatgaaagtctggcactaagtttgttgtcatgaatgtaaagggttaatagcatggctttatatttttctccagacatgtttgcttgcatgggtttagggatgtgaagtcagacagttggatttagccaggaatgtggtattgcaaggtaagtaggacaaaaagagagagtgtgtcaggagagttgggaatgtactgaaggaagtgatgggccttgaactcaatgctggtgagcatagaagtgaggacatgaggttggtgagggggcagtaaaaaggtggtaggatcaagactgtaggtcctggtgaagtgggaaaattgtgagagtagggatattagagggagtgaattggccagacacaaggtggtggctggatagtagggtgcatgacagaggttatggagagatcacagccattaacagtaactggtgtgaccatgtgaaaaaggtgtgaggtaaaatggagaggagaccttgaggagcatggagggcaaggcattgagaggccagggtgttgctaaatattgataccgcagagattttgacaaaggaatgttggaaaggcatcacagggaggggaaaggcaaaaccttcaaggactgaagaagggagggtatacatggagggggccgtaaatccgtaaatgactgcaacagaaaggagtagtgggtgccatagtctcaggacatgagattcaaatcagcagagtggttagcaaggaggcagagagaatggtctggaagagacagcaatttagaaacatctgtgaggcacagagaggcactcccttggcccagttgtgtaaggttatatgagaagaaaaacccccactacttgagagagctgtcaggatagcagtgtcttcagagaggaagaactaagtttttcttaaagaaaaaaggtgaagggactgctcaggtgactgatgtaaacagggaagtaggggcgtggtgggatcagtggtctccatggcagaggacagtggtgtagctgtcagggttgtagagtgggaggaaggaggttgagattctttccacgaacagagtccacgcacctactgtttcagacagtctaaactctagagccctagagaactttaccactctggtcttttgattctaaaaaggatgttgacttgtgagaaggtagttaatgacctgtgttgcttaaagcatttttattacttttgactttaaattgcattgatgcaggactttttgtctataacctcaggattcctccagctgaaaaagaaccaggctatgtatattagagtggaattccaggtatgagttctctagtgtgtagaaatgaattaaccaagtggaactctttctagggaagtatggcatttcacagatattacttgtaaaatggggaaaagagggtcaggggaggctcgctgagaaagttcccagaactcagcccagactcggtgctcagtaaagaactgtcttagctgggcatcatggtgcatgcctatagtcccagctacttgggaggttaaggcaggaggattgcttgagcccaggagctcagggctgtagcatgccatgattgtgcatgagaatagccactgtactgcagcctgggtgacataatgagaccctatttctttaaaaacaaaaacaaaaactttttcctccattattgattgccctttccccctgtccctgtgcctattgctgtttctttggatgttatttaatttctctgtgccttagtttcctgtatgtcagatgcgcatgatcatagtccctacttcataggaaagttgtaataattaaatgagataacactatgtgtattagtccgttttcatgctgctgataaagacatacacaagactgggtaacttataaagaaaaagaggtttaatggactcacagttccatgtagctggggaggcctcacaatcatggcagaaggtgaaaagcacgtcttacatggtggcaggcaagagagaatgagagccaagtgaaaggggaaaccccttataaaaccatcagatctcatgagacttattcactaccaccagaacagtatggaggaaaatgcccccatgattcagttatctcccactgggtccctcccacagcacgtgggaattatgggaggtacaattcaagataagatttgggtggggtcacagccaaaacatatcaacgtatagaaatatttaacacagtacatggtacataatataagtacttaaatatgatttgctattaaatgacaagtggtaagttcttggctcccattcaactctcttattcttgccattatgtttcttcttacttcaccccctttctcttacatcttcttccctttctctccttctttttccacacttcctccttaacctatttcctctttccctcccctggctttggttgcagtggcatatgcacctagttcagtactctttgtggccccctgaagtagagaagtcttagagtaggggtgaggcagccatcagaggaaggaaactgctggtggggacagtctcttggccattccatctgaagtctgtagtgtagccatggtggctgcagagatgcaaagggccagtgacaagaggctcaggagctgggaggcctatgttgcagggcaagtttggctactgtgtgatgtgtggctggggcaccagacagtaggcagagcatgctatgaagatgaggatcatttgaacaggaagggactgggctaaatcaccatgtggagggacgagtgaggacatgtgcatgtcctgcccctggtcctgttgctgataccactatgactactcccattcataagggtggctcctccccacggggcatctcctgtcagtcggccttctgtgggagggagcgagtgagcaaaggatagctgagtgtgctggctaagactataaattctagagccaaactgcttggatttgaatcctggctctgtcaccgaatgagaatgtatccttgagtaagttatctaacttttctgtgcctcagtgtcccatctctaaaatggatataattggaacaatacagttcttatgaggatttgtttaaattaacagtttacaaagtgattttcatagttcatggcataaaagaagtacgatgtgagtttttgttatattttaaaaattttaaaaatcatacaacaatcttagaagacttactttcattttaccgatgccaaaacggaggtggagaggttaagggccttggccaaggccacagagctaccgagcagcagagtcaaatctagaacacagctttgacatactccaaagtcctagcttgtaactgcaatgcttaactgcctccctggacattcaggtggagactttgctttctaggagagctgggaggcagggtgaggcaggtgggcaatgtgagtcaaggtgggtggtcagcagttggagtctgagaggttgggagaagtactgcttgaggacacacctgggactagtggctgcatgcccttggcccggctccttggttggggagagcagcctggcttcccaggcccatttcagggacaggtcaagtcccttaggtgcatgaaggtgctgatttcagccagagagctaagccttcttgggactttttccttccttccctattttccaggtgacctcagtgaagttaataacccttttgcacctcagtttcctcatctgtcaattgaggataatactttacctgtctgcttcctgggtattttgagacattgagtagattgtggatgtgaaatcatttgaaaagcataaagcagtacctaaatttaagatactagagtgatctcagaccacattactgtgagggtccagtgtagatctctcaggcctctccatagctaccttgtgctgataatgcccagtgtccaatttcatgaccttttccagctggggtctacagtgatacttggactcttacctccttttctcagtttttacatttcccttggtgagtgtaaagtaatagttgagcagcatgtgggtccctgggaaattattttccgtgtggatttttatttttaagagccagagccaacgtctgtgtccagcctccacagttgtcccagctcccattctgggagctctgccatcttcttggtttcagcccttggcataagacagacctgggctcctgtggctggggagcctgtaactgcctcctctcattagcagacagtcttggttatgtgcttgccctgtggggaacagggaggcagctgaccctttcccctgggtgcctttgtctgtcctggcatactttggggtgtgtgtgtgtgtgtgtgtgtgtgtgtgtacacgtgtgtgtgtatgttagagattctgtaagcccaagaggctaggcctcttgtcagctgccaaagttcttttttccccagaattgagttagccacccaactgtttccattctctgcccgctgcgaagctctacagcagggctgctgtggcaggtcaaaacatgctctgctttgagaatacagagattccattttgagagagatgggaaacaggagcgagtgagtgggtgtgttggatgtagggaaagtgaggacattctttttggtaagctgtgccaaaattggcccagaagcttggtctaaactcaaaagtagggctaatgctgggctgacacccaaatatccaatggggaaagtttattcttggatctagaccctatgagacctagcaatcatttttttttctcatctggaatatggggataattctactccatatattcttcatgtcaaatgagaaataaacttgtaaatagtctaccgtctagtctccaggagcaggaagtgacataaggttgtgattcttaaagtattttgcagaatacaaactgttactaaaaaaagaatcacttgctaaataagtttggggaacactggataaacaatggcatgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatcctcggcctggtaagtttggttatatccccttctatcccctctgtttgcagttctccataaatcttggtaatcctggttggtgctgacgtatcactttgttttgaaaatgcaagatgctaaaggccaggatgtcagattgttgtgtctggattgctgatttatgatctacagccttggcctctccaaagagttttctgagtctttcagtaatgactgtttctttcatccctggggaggcaaggatgcctttcactcatggccacttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctg
